(12) United States Patent
Ciaramella et al.

(10) Patent No.: US 9,872,900 B2
(45) Date of Patent: *Jan. 23, 2018

(54) NUCLEIC ACID VACCINES

(71) Applicant: ModernaTX, Inc., Cambridge, MA (US)

(72) Inventors: Giuseppe Ciaramella, Sudbury, MA (US); Axel Bouchon, Kleinmacknow (DE); Eric Yi-Chun Huang, Boston, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/091,123

(22) Filed: Apr. 5, 2016

(65) Prior Publication Data
US 2016/0331828 A1 Nov. 17, 2016

Related U.S. Application Data

(63) Continuation of application No. 15/089,050, filed on Apr. 1, 2016, which is a continuation of application No. PCT/US2015/027400, filed on Apr. 23, 2015.

(60) Provisional application No. 62/088,994, filed on Dec. 8, 2014, provisional application No. 61/983,250, filed on Apr. 23, 2014.

(51) Int. Cl.
| | |
|---|---|
| *A61K 39/145* | (2006.01) |
| *A61K 48/00* | (2006.01) |
| *A61K 39/12* | (2006.01) |
| *A61K 39/39* | (2006.01) |
| *C12N 7/00* | (2006.01) |
| *A61K 31/7105* | (2006.01) |
| *A61K 9/00* | (2006.01) |
| *A61K 39/155* | (2006.01) |
| *A61K 9/127* | (2006.01) |
| *A61K 9/51* | (2006.01) |
| *A61K 39/00* | (2006.01) |

(52) U.S. Cl.
CPC .......... *A61K 39/145* (2013.01); *A61K 9/0019* (2013.01); *A61K 9/1271* (2013.01); *A61K 9/5123* (2013.01); *A61K 9/5146* (2013.01); *A61K 31/7105* (2013.01); *A61K 39/12* (2013.01); *A61K 39/155* (2013.01); *A61K 39/39* (2013.01); *A61K 48/00* (2013.01); *C12N 7/00* (2013.01); *A61K 2039/53* (2013.01); *A61K 2039/545* (2013.01); *A61K 2039/55555* (2013.01); *C12N 2760/16122* (2013.01); *C12N 2760/16134* (2013.01); *C12N 2760/16234* (2013.01)

(58) Field of Classification Search
None
See application file for complete search history.

(56) References Cited

U.S. PATENT DOCUMENTS

| | | | |
|---|---|---|---|
| 5,824,497 | A | 10/1998 | Andrews et al. |
| 5,861,501 | A | 1/1999 | Benseler et al. |
| 5,989,911 | A | 11/1999 | Fournier et al. |
| 6,500,419 | B1 | 12/2002 | Hone et al. |
| 6,534,312 | B1 | 3/2003 | Shiver et al. |
| 6,652,886 | B2 | 11/2003 | Ahn et al. |
| 6,696,038 | B1 | 2/2004 | Mahala et al. |
| 6,924,365 | B1 | 8/2005 | Miller et al. |
| 7,001,890 | B1 | 2/2006 | Wagner et al. |
| 7,316,925 | B2 | 1/2008 | Draghia-Akli et al. |
| 7,371,404 | B2 | 5/2008 | Panzner et al. |
| 7,566,454 | B2 † | 7/2009 | Lu |
| 7,776,523 | B2 | 8/2010 | Garcia et al. |
| 7,884,184 | B2 | 2/2011 | DeGroot et al. |
| 7,943,168 | B2 | 5/2011 | Schlesinger et al. |
| 8,058,069 | B2 | 11/2011 | Yaworski et al. |
| 8,158,601 | B2 | 4/2012 | Chen et al. |
| 8,178,660 | B2 | 5/2012 | Weiner et al. |
| 8,217,016 | B2 | 7/2012 | Hoerr et al. |
| 8,278,036 | B2 | 10/2012 | Kariko et al. |
| 8,383,340 | B2 | 2/2013 | Ketterer et al. |
| 8,470,771 | B2 | 6/2013 | Gao et al. |
| 8,506,966 | B2 | 8/2013 | Podda et al. |
| 8,569,256 | B2 | 10/2013 | Heyes et al. |
| 8,628,801 | B2 | 1/2014 | Garreta et al. |
| 8,642,076 | B2 | 2/2014 | Manoharan et al. |
| 8,663,599 | B1 | 3/2014 | Sung et al. |
| 8,691,223 | B2 | 4/2014 | Van Den Brink et al. |
| 8,691,750 | B2 | 4/2014 | Constein et al. |

(Continued)

FOREIGN PATENT DOCUMENTS

| | | |
|---|---|---|
| AU | 652831 B2 | 9/1994 |
| EP | 0204401 | 12/1986 |

(Continued)

OTHER PUBLICATIONS

[No Author Listed], "Messenger RNA", Internet: Wikipedia. Jun. 19, 2013, XP002699196, Retrieved from the Internet: URL: http://en.wikipedia.org/wiki/Messenger RNA. 10 pages.

Aleku, M., et al., Atu027, a liposomal small interfering RNA formulation targeting protein kinase N3, inhibits cancer progression. Cancer Res. 2008; 68: 9788-9798.

Alfonso et al., An Anti-Idiotype Vaccine Elicits a Specific Response to N-Glycolyl Sialic Acid Residues of Glycoconjugates in Melanoma Patients, The Journal of Immunology, 2002, vol. 168, No# , pp. 3523-2529.

Anderson, B.R., et al., Nucleoside modifications in RNA limit activation of 2'-5'-oligoadenylate synthetase and increase resistance to cleavage by Rnase J. Nucleic Acids Res. 2011; 1-10.

(Continued)

*Primary Examiner* — Benjamin P Blumel

(74) *Attorney, Agent, or Firm* — Wolf, Greenfield & Sacks, P.C.

(57) ABSTRACT

The invention relates to compositions and methods for the preparation, manufacture and therapeutic use ribonucleic acid vaccines (NAVs) comprising polynucleotide molecules encoding one or more antigens.

26 Claims, 86 Drawing Sheets

(56) References Cited

U.S. PATENT DOCUMENTS

| | | | |
|---|---|---|---|
| 8,710,200 B2 | 4/2014 | Schrum et al. |
| 8,822,663 B2 | 9/2014 | Schrum et al. |
| 8,883,202 B2 | 11/2014 | Manoharan et al. |
| 8,927,692 B2 | 1/2015 | Weiner et al. |
| 9,008,142 B2 | 4/2015 | Minneman et al. |
| 9,018,089 B2 | 4/2015 | Liniger et al. |
| 9,139,554 B2 | 9/2015 | Hope et al. |
| 9,192,651 B2 | 11/2015 | Bancel et al. |
| 9,220,683 B2 | 12/2015 | Manoharan et al. |
| 9,226,959 B2 | 1/2016 | Kramps et al. |
| 9,234,013 B2 | 1/2016 | Thess et al. |
| 2002/0137720 A1 | 9/2002 | Ertl et al. |
| 2003/0032615 A1 | 2/2003 | Felgner et al. |
| 2003/0073619 A1 | 4/2003 | Mahato et al. |
| 2003/0083272 A1 | 5/2003 | Wiederholt et al. |
| 2003/0092653 A1 | 5/2003 | Kisich et al. |
| 2004/0167090 A1 | 8/2004 | Monahan et al. |
| 2005/0032730 A1 | 2/2005 | Von Der Mulbe et al. |
| 2005/0059624 A1 | 3/2005 | Hoerr et al. |
| 2005/0250723 A1 | 11/2005 | Hoerr et al. |
| 2006/0083780 A1 | 4/2006 | Heyes et al. |
| 2006/0188490 A1 | 8/2006 | Hoerr et al. |
| 2007/0141030 A1 | 6/2007 | Yu et al. |
| 2007/0252295 A1 | 11/2007 | Panzner et al. |
| 2007/0280929 A1 | 12/2007 | Hoerr et al. |
| 2008/0025944 A1 | 1/2008 | Hoerr et al. |
| 2008/0057080 A1 | 3/2008 | Luke et al. |
| 2008/0057081 A1* | 3/2008 | Yang ............... A61K 39/145 424/206.1 |
| 2008/0076174 A1 | 3/2008 | Selden et al. |
| 2008/0171711 A1 | 7/2008 | Hoerr et al. |
| 2008/0267873 A1 | 10/2008 | Hoerr et al. |
| 2008/0274463 A1 | 11/2008 | Chen et al. |
| 2009/0042825 A1 | 2/2009 | Matar et al. |
| 2009/0093433 A1 | 4/2009 | Woolf et al. |
| 2009/0286852 A1 | 11/2009 | Kariko et al. |
| 2010/0015232 A1 | 1/2010 | Besenbacher et al. |
| 2010/0028943 A1 | 2/2010 | Thomas et al. |
| 2010/0047261 A1 | 2/2010 | Hoerr et al. |
| 2010/0129877 A1 | 5/2010 | Sahin et al. |
| 2010/0189729 A1 | 7/2010 | Hoerr et al. |
| 2010/0203076 A1 | 8/2010 | Fotin-Mleczek et al. |
| 2010/0239608 A1 | 9/2010 | Von Der Mulbe et al. |
| 2010/0260817 A1 | 10/2010 | Slobodkin et al. |
| 2010/0273220 A1 | 10/2010 | Yanik et al. |
| 2010/0285135 A1 | 11/2010 | Wendorf et al. |
| 2010/0291156 A1 | 11/2010 | Barner et al. |
| 2010/0303851 A1 | 12/2010 | Hoerr et al. |
| 2010/0305196 A1 | 12/2010 | Probst et al. |
| 2011/0045022 A1 | 2/2011 | Tsai |
| 2011/0053829 A1 | 3/2011 | Baumhof et al. |
| 2011/0077287 A1 | 3/2011 | Von Der Mulbe et al. |
| 2011/0086904 A1 | 4/2011 | Russell |
| 2011/0143397 A1 | 6/2011 | Kariko et al. |
| 2011/0143436 A1 | 6/2011 | Dahl et al. |
| 2011/0200582 A1 | 8/2011 | Baryza et al. |
| 2011/0244026 A1 | 10/2011 | Guild et al. |
| 2011/0250225 A1 | 10/2011 | Fotin-Mleczek et al. |
| 2011/0256175 A1† | 10/2011 | Hope |
| 2011/0269950 A1 | 11/2011 | Von Der Mulbe et al. |
| 2011/0300205 A1 | 12/2011 | Geall et al. |
| 2011/0311472 A1 | 12/2011 | Hoerr et al. |
| 2012/0009221 A1 | 1/2012 | Hoerr et al. |
| 2012/0021042 A1 | 1/2012 | Panzner et al. |
| 2012/0027813 A1 | 2/2012 | Podda et al. |
| 2012/0046346 A1 | 2/2012 | Rossi et al. |
| 2012/0053333 A1 | 3/2012 | Mauro et al. |
| 2012/0069014 A1 | 3/2012 | Wong et al. |
| 2012/0177724 A1 | 7/2012 | Irvine et al. |
| 2012/0178702 A1 | 7/2012 | Huang |
| 2012/0189700 A1 | 7/2012 | Aguilar et al. |
| 2012/0195917 A1 | 8/2012 | Sahin et al. |
| 2012/0195936 A1 | 8/2012 | Rudolph et al. |
| 2012/0213818 A1 | 8/2012 | Hoerr et al. |
| 2012/0219573 A1 | 8/2012 | Baumhof et al. |
| 2012/0237975 A1 | 9/2012 | Schrum et al. |
| 2012/0252117 A1 | 10/2012 | Selden et al. |
| 2012/0295832 A1 | 11/2012 | Constien et al. |
| 2012/0301955 A1 | 11/2012 | Thomas et al. |
| 2013/0017223 A1 | 1/2013 | Hope et al. |
| 2013/0022538 A1 | 1/2013 | Rossi |
| 2013/0064894 A1 | 3/2013 | Martin et al. |
| 2013/0065942 A1 | 3/2013 | Matar et al. |
| 2013/0090372 A1 | 4/2013 | Budzik et al. |
| 2013/0111615 A1 | 5/2013 | Kariko et al. |
| 2013/0115274 A1 | 5/2013 | Knopov et al. |
| 2013/0116307 A1 | 5/2013 | Heyes et al. |
| 2013/0121988 A1 | 5/2013 | Hoerr et al. |
| 2013/0123338 A1 | 5/2013 | Heyes et al. |
| 2013/0129785 A1 | 5/2013 | Manoharan et al. |
| 2013/0142818 A1 | 6/2013 | Baumhof et al. |
| 2013/0149375 A1 | 6/2013 | Geall |
| 2013/0150625 A1 | 6/2013 | Budzik et al. |
| 2013/0156845 A1 | 6/2013 | Manoharan et al. |
| 2013/0164400 A1 | 6/2013 | Knopov et al. |
| 2013/0171241 A1 | 7/2013 | Geall |
| 2013/0177587 A1 | 7/2013 | Robinson et al. |
| 2013/0177639 A1 | 7/2013 | Geall et al. |
| 2013/0177640 A1† | 7/2013 | Geall |
| 2013/0178541 A1 | 7/2013 | Stanton et al. |
| 2013/0183355 A1 | 7/2013 | Jain et al. |
| 2013/0189351 A1 | 7/2013 | Geall |
| 2013/0195867 A1 | 8/2013 | Hoerr et al. |
| 2013/0195967 A1 | 8/2013 | Guild et al. |
| 2013/0195969 A1 | 8/2013 | Geall et al. |
| 2013/0197068 A1 | 8/2013 | Kariko et al. |
| 2013/0202645 A1 | 8/2013 | Barner et al. |
| 2013/0202684 A1 | 8/2013 | Geall et al. |
| 2013/0236533 A1 | 9/2013 | Von Andrian et al. |
| 2013/0245104 A1 | 9/2013 | de Fougerolles et al. |
| 2013/0245107 A1 | 9/2013 | de Fougerolles et al. |
| 2013/0266640 A1 | 10/2013 | de Fougerolles et al. |
| 2013/0274504 A1 | 10/2013 | Colletti et al. |
| 2013/0274523 A1 | 10/2013 | Bawiec, III et al. |
| 2013/0280283 A1 | 10/2013 | Lorenz et al. |
| 2013/0287832 A1 | 10/2013 | O'Hagan |
| 2013/0295043 A1† | 11/2013 | Kallen |
| 2013/0330401 A1 | 12/2013 | Payne et al. |
| 2013/0336998 A1† | 12/2013 | Kallen |
| 2014/0037660 A1 | 2/2014 | Folin-Mleczek et al. |
| 2014/0039032 A1 | 2/2014 | Kumboyama et al. |
| 2014/0044772 A1 | 2/2014 | Maclachlan et al. |
| 2014/0044791 A1 | 2/2014 | Basilion et al. |
| 2014/0045913 A1 | 2/2014 | Kumboyama et al. |
| 2014/0065204 A1 | 3/2014 | Hayes et al. |
| 2014/0112950 A1 | 4/2014 | Singh et al. |
| 2014/0121393 A1 | 5/2014 | Manoharan et al. |
| 2014/0127248 A1 | 5/2014 | Ross et al. |
| 2014/0134129 A1 | 5/2014 | Thalhamer et al. |
| 2014/0134201 A1 | 5/2014 | Tureci et al. |
| 2014/0141070 A1 | 5/2014 | Geall et al. |
| 2014/0147454 A1 | 5/2014 | Chakraborty et al. |
| 2014/0193484 A1 | 7/2014 | Girard et al. |
| 2014/0200257 A1 | 7/2014 | Rajeev et al. |
| 2014/0212498 A1 | 7/2014 | Brito et al. |
| 2014/0220083 A1 | 8/2014 | Brito et al. |
| 2014/0227346 A1 | 8/2014 | Geall et al. |
| 2014/0242152 A1 | 8/2014 | Geall et al. |
| 2014/0248320 A1 | 9/2014 | Tsai et al. |
| 2014/0255472 A1 | 9/2014 | Geall et al. |
| 2014/0271829 A1 | 9/2014 | Lilja et al. |
| 2014/0308304 A1 | 10/2014 | Manoharan et al. |
| 2014/0348924 A1 | 11/2014 | Pascolo et al. |
| 2014/0378538 A1 | 12/2014 | Bancel |
| 2015/0030669 A1 | 1/2015 | Platscher et al. |
| 2015/0056253 A1 | 2/2015 | Bancel et al. |
| 2015/0064233 A1 | 3/2015 | Shih et al. |
| 2015/0086612 A1 | 3/2015 | Sahin et al. |
| 2015/0086613 A1 | 3/2015 | DeRosa et al. |
| 2015/0118183 A1 | 4/2015 | Baumhof et al. |
| 2015/0118264 A1 | 4/2015 | Baumhof et al. |
| 2015/0141499 A1 | 5/2015 | Bancel et al. |
| 2015/0184195 A1 | 7/2015 | Thess et al. |
| 2015/0202153 A1 | 7/2015 | Frank et al. |

(56) References Cited

U.S. PATENT DOCUMENTS

| | | |
|---|---|---|
| 2015/0203446 A1 | 7/2015 | Manoharan et al. |
| 2016/0022806 A1 | 1/2016 | Weiner et al. |
| 2016/0024139 A1 | 1/2016 | Scorza et al. |
| 2016/0032284 A1 | 2/2016 | Chen et al. |
| 2016/0032316 A1 | 2/2016 | Weissman et al. |

FOREIGN PATENT DOCUMENTS

| | | |
|---|---|---|
| EP | 1083232 | 2/2005 |
| EP | 1383556 | 10/2007 |
| EP | 1619254 | 12/2010 |
| EP | 2548960 | 1/2013 |
| WO | WO 1990/011092 | 10/1990 |
| WO | WO 1995/033835 | 12/1995 |
| WO | WO 1997/048370 | 12/1997 |
| WO | WO 1998/000547 | 1/1998 |
| WO | WO 1998/012207 | 3/1998 |
| WO | WO 1999014346 A2 | 3/1999 |
| WO | WO 1999/052503 | 10/1999 |
| WO | WO 2000/029561 | 5/2000 |
| WO | WO 2000/050586 | 8/2000 |
| WO | WO 2002/064799 | 8/2002 |
| WO | WO 2003059381 A2 | 7/2003 |
| WO | WO 2007/064952 A2 | 3/2007 |
| WO | WO 2008/011609 A1 | 1/2008 |
| WO | WO 2008/014979 | 2/2008 |
| WO | WO 2008/151049 A2 | 12/2008 |
| WO | WO 2009/046738 | 4/2009 |
| WO | WO 2009/046739 | 4/2009 |
| WO | WO 2009/127060 A1 | 10/2009 |
| WO | WO 2009/127230 A1 | 10/2009 |
| WO | WO 2010/037408 A1 | 4/2010 |
| WO | 2010060430 A2 † | 6/2010 |
| WO | WO 2010/088537 A3 | 8/2010 |
| WO | WO 2010/088927 A1 | 8/2010 |
| WO | WO 2010/144740 A1 | 12/2010 |
| WO | WO 2011/005799 A2 | 1/2011 |
| WO | WO 2011/106607 A1 | 2/2011 |
| WO | WO 2011/068810 A1 | 6/2011 |
| WO | WO 2011/071931 A2 | 6/2011 |
| WO | WO 2011/127255 A1 | 10/2011 |
| WO | WO 2011/130624 A2 | 10/2011 |
| WO | WO 2011/144358 A1 | 11/2011 |
| WO | WO 2012/006359 A1 | 1/2012 |
| WO | WO 2012/006372 A1 | 1/2012 |
| WO | WO 2012/006376 A2 | 1/2012 |
| WO | WO 2012/006380 A2 | 1/2012 |
| WO | WO 2012/019630 A1 | 2/2012 |
| WO | WO 2012/030683 A2 | 3/2012 |
| WO | WO 2012/031043 A1 | 3/2012 |
| WO | WO 2012/031046 A2 | 3/2012 |
| WO | WO 2012/045082 A2 | 4/2012 |
| WO | WO 2012/051211 A1 | 4/2012 |
| WO | WO 2012/072269 A1 | 6/2012 |
| WO | WO 2012/089225 A1 | 7/2012 |
| WO | WO 2012/099805 A2 | 7/2012 |
| WO | WO 2012/113413 A1 | 8/2012 |
| WO | WO 2012/113513 A1 | 8/2012 |
| WO | WO/12/116810 * | 9/2012 |
| WO | WO 2012/116714 A1 | 9/2012 |
| WO | WO 2012/116715 A1 | 9/2012 |
| WO | WO 2012/138453 A1 | 10/2012 |
| WO | WO 2012/149045 A2 | 11/2012 |
| WO | WO 2012/149376 A2 | 11/2012 |
| WO | WO 2012/159754 A1 | 11/2012 |
| WO | WO 2012/170889 A1 | 12/2012 |
| WO | WO 2012/170930 A1 | 12/2012 |
| WO | WO 2012/045075 A1 | 4/2013 |
| WO | WO 2013/052167 A2 | 4/2013 |
| WO | WO 2013/055905 A1 | 4/2013 |
| WO | WO 2013/059496 A1 | 4/2013 |
| WO | WO 2013/075266 A1 | 5/2013 |
| WO | WO 2013/078199 A2 | 5/2013 |
| WO | WO/13/090186 * | 6/2013 |
| WO | WO 2013/093648 A2 | 6/2013 |
| WO | WO 2013/113326 A1 | 8/2013 |
| WO | WO 2013/143555 A1 | 10/2013 |
| WO | WO 2013/185069 A1 | 12/2013 |
| WO | WO 2014/028487 A1 | 2/2014 |
| WO | WO 2014/028763 A1 | 2/2014 |
| WO | WO 2014/071963 A1 | 5/2014 |
| WO | WO 2014/072061 A1 | 5/2014 |
| WO | WO 2014/074912 A1 | 5/2014 |
| WO | WO 2014071219 A1 | 5/2014 |
| WO | WO 2014/108515 A1 | 7/2014 |
| WO | WO 2014/127917 A1 | 8/2014 |
| WO | WO 2014/152774 A1 | 9/2014 |
| WO | 2014153674 A1 † | 10/2014 |
| WO | WO 2014/210356 A1 | 12/2014 |
| WO | WO 2015/023461 A2 | 2/2015 |
| WO | WO 2015/024667 A1 | 2/2015 |
| WO | WO 2015/024668 A2 | 2/2015 |
| WO | WO 2015/024669 A1 | 2/2015 |
| WO | WO 2015/130584 A2 | 9/2015 |
| WO | WO 2015/135558 A1 | 9/2015 |
| WO | WO 2015/149944 A2 | 10/2015 |
| WO | WO 2015/164674 A1 | 10/2015 |
| WO | WO 2016/128376 A1 | 8/2016 |

OTHER PUBLICATIONS

Anderson, D.M. et al., Stability of mRNA/cationic lipid lipoplexes in human and rat cerebrospinal fluid: methods and evidence for nonviral mRNA gene delivery to the central nervous system. Hum Gene Ther. Feb. 10, 2003;14(3):191-202.

Anderson, et al. The Bridge, National Academy of Engineering of the National Academies, Fall 2006, vol. 36., No. 3, pp. 1-55.

Anderson, et al., Incorporation of pseudouridine into mRNA enhances translation by diminishing PKR activation, Nucleic Acids Res. vol. 38, No. 17, Sep. 1, 2010, pp. 5884-5892.

Andries, et al., Comparison of the gene transfer efficiency of mRNA/GL67 and pDNA/GL67 complexes in respiratory cells. Mol Pharmaceutics. 2012; 9: 2136-2145.

Apostolopoulos, V. et al., Cellular mucins: targets for immunotherapy. Crit Rev lmmunol. 1994;14(3-4):293-309.

Archer, S.J., Induction of a T-cell specific antigen on bone marrow lymphocytes with thymus RNA. Immunology. Jan. 1978;34(1):123-9.

Ashley, D.M. et al., Bone marrow-generated dendritic cells pulsed with tumor extracts or tumor RNA induce antitumor immunity against central nervous system tumors. J Exp Med. Oct. 6, 1997; 186(7): 1177-82.

Ast, G., How did alternative splicing evolve? Nat Rev Genet. Oct. 2004;5(10):773-82.

Aurup, H. et al., Translation of 2'-modified mRNA in vitro and in vivo. Nucleic Acids Res. Nov. 25, 1994;22(23):4963-8.

Baars et al., A Phase II Study of Active Specific lmmunotherapy and 5-FU/Leucovorin as Adjuvant Therapy for Stage III Colon Carcinoma, British Journal of Cancer, 2002, vol. 86, No. 8, pp. 1230-1234.

Badis, G. et al., A snoRNA that guides the two most conserved pseudouridine modifications within rRNA confers a growth advantage in yeast. RNA. Jul. 2003; 9(7): 771-779.

Baker, et al., RNA-guided RNA modification: functional organization of the archaeal H/ACA RNP. Genes Dev. May 15, 2005;19(10):1238-48. Epub May 3, 2005.

Barr, Ian et al., Epidemiological, Antigen and Genetic Characteristics of Seasonal Influenza a(H1N1), A (H3N2) and B Influenza Virus: Basis for WHO Recommendation on the Competition of Influenza Vaccines for Using in the 2009-2010 Northern Hemisphere Season, Vaccine, 2010, vol. 28, No number, pp. 1156-1167.

Basarkar, A. et al., Nanoparticulate systems for polynucleotide delivery. Int J Nanomedicine. 2007; 2(3): 353-360.

Belliveau, N.M., et al., Microfluidic synthesis of highly potent limit-size lipid nanoparticles for in vivo delivery of siRNA. Mol Ther Nucleic Acids. Aug. 2012; 1(8): e37.

Bernstein, P. et al., Poly(A), poly(A) binding protein and the regulation of mRNA stability. Trends Biochem Sci. Sep. 1988;14(9):373-7.

(56) References Cited

OTHER PUBLICATIONS

Bevilacqua, A. et al., Post-transcriptional regulation of gene expression by degradation of messenger RNAs. J Cell Physiol. Jun. 2003;195(3):356-72.

Biopharma, Sample Synagis, MedImmune, Inc., 2013, No Vol. pp. 1-19.

Boczkowski, D. et al., Induction of tumor immunity and cytotoxic T lymphocyte responses using dendritic cells transfected with messenger RNA amplified from tumor cells. Cancer Res. Feb. 15, 2000;60(4):1028-34.

Bolhassani A., et al., Improvement of Different Vaccine Delivery Systems for Cancer Therapy, Molecular Cancer, Biomed Central, London, GB, 2011, vol. 10, No. 3, pp. 1-20.

Bouloy, M., et al., Both the 7-methyl and the 2'-0-methyl groups in the cap of mRNA strongly influence its ability to act as primer for influenza virus RNA transcription. Proc. Natl. Acad. Sci. USA, vol. 77, No. 7, pp. 3952-3956, Jul. 1980.

Brandenburg et al., Mechanisms of Hemagglutinin Targeted influenza Virus Neutralization, PLOS One, 2013, vol. 8, Issue 12, pp. 1-14.

Cannon, G. et al., RNA based vaccines. DNA Cell Biol. Dec. 2000;21(12):953-61.

Carralot, J.P. et al., Polarization of immunity induced by direct injection of naked sequence-stabilized mRNA vaccines. Cell Mal Life Sci. Sep. 2004;61(18):2418-24.

Charette, M. et al., Pseudouridine in RNA: what, where, how, and why. IUBMB Life. May 2000;49(5):341-51.

Chen et al., A Flexible RNA Backbone within the Polypyrimidine Tract Is Required for U2AF65 Binding and Pre-mRNA Splicing In Vivo, Molecular and Cellular Biology, 2010, vol. 30, No. 17, pp. 4108-4119.

Chen et al., Vaccination of Monoglycosylated Hemagglutinin Induces Cross-Strain Protection Against Influenza Virus Infection, PNAS, 2013, No Volume Number, pp. 1-6.

Chen, Z. et al., Enhanced protection against a lethal influenza virus challenge by immunization with both hemagglutinin- and neuraminidase-expressing DNAs. Vaccine. Feb. 26, 1999;17(7-8):653-9.

Cheng, C., et al., Multifunctional triblock copolymers for intracellular messenger RNA delivery. Biomaterials. Oct. 2012; 33(28): 6868-6876.

Cheng, W.F. et al., Enhancement of Sindbis virus self-replicating RNA vaccine potency by linkage of herpes simplex virus type 1 VP22 protein to antigen. J Virol. Mar. 2001;75(5):2368-76.

Colter, J.S., et al., Infectivity of ribonucleic acid isolated from virus-infected tissues. Virology. 1957; 4(3): 522-532.

Condon, C. et al., DNA-based immunization by in vivo transfection of dendritic cells. Nat Med. Oct. 1996;2 (10):1122-8.

Conry, R.M. et al., Characterization of a messenger RNA polynucleotide vaccine vector. Cancer Res. Apr. 1, 1995 ;55 (7):1397-1400.

Cosman et al., ULBPs, Novel MHC Class I-Related Molecules, Bind to CMV Glycoprotein UL 16 and Stimulate NK Cytotoxicity through the NKG2D Receptor, lmmunity,2001, vol. 14, No Vol. pp. 123-133.

Cowling (Jan. 15, 2010, online Dec. 23, 2009, "Regulation of mRNA cap methylation," Biochemical Journal, 425 (Pl 2): 295-302.

Cu et al., Enhanced Delivery and Potency of Self-Amplifying mRNA Vaccines by Electroporation in Situ, Vaccines, 2013, 1, 367-383. Abstract Only.

Cuburu, N. et al., lntravaginal immunization with HPV vectors induces tissue-resident CDS+ T cell responses. J Clin Invest. Dec. 3, 2012; 122(12): 4606-4620.

Davis, D.R. Stabilization of RNA stacking by pseudouridine. Nucleic Acids Res. 1995; 23(24): 5020-5026.

Dean et al., Rapid amplification of plasmid and phage DNA using Phi 29 DNA polymerase and multiply-primed rolling circle amplification. Genome Res. Jun. 2001;11(6):1095-9.

Deering, et al., Nucleic Acid Vaccines: Prospects for Non-Viral Delivery of mRNA Vaccines, Expert Opinion, 2014, vol. 11, No. 6, pp. 1-15.

Delehanty, Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.

DeMarco et al., A Non-VH1-69 Heterosubtypic Neutralizing Human Monoclonal Antibody Protects Mice Against H1N1 and H5N1 Viruses, PLOS One, Apr. 2012, vol. 7, Issue 4, pp. 1-9.

Diebold, S.S. et al., Innate antiviral responses by means of TLR7-medialed recognition of single-stranded RNA. Science. Mar. 5, 2004;303(5663):1529-31. Epub Feb. 19, 2004.

Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015. Review.

Disbrow, G.L. et al., Codon optimization of the HPV-16 E5 gene enhances protein expression. Virology. Jun. 20, 2003;311(1 ):105-14.

Ducani et al., Rolling circle replication requires single-stranded DNA binding protein to avoid termination and production of double-stranded DNA. Nucleic Acids Res. 2014;42(16):10596-604. doi:10.1093/nar/gku737. Epub Aug. 12, 2014.

Dunham, S.P. et al., The application of nucleic acid vaccines in veterinary medicine. Res Vet Sci. Aug. 2002;73 (1):9-16.

Edelheit, et al., Transcriptome-Wide Mapping of 5-methylcytidine RNA Modifications in Bacteria, Archaea, and Yeast Reveals m5C within Archaeal mRNAs. PLOS Genetics, Jun. 2013, vol. 9, Issue 6, pp. 1-14.

El Ouahabi, A., et al., Double long-chain amidine liposome-mediated self replicating RNA transfection. FEBS Letters. Feb. 1996; 380(1-2): 108-112.

Felgner, PL Cationic lipid/polynucleotide condensates for in vitro and in vivo polynucleotide delivery—the cytofectins. J. of Liposome Research. 1993; 3(1): 3-16.

Felgner, PL Particulate systems and polymers for in vitro and in vivo delivery of polynucleotides. Adv. Drug Delivery Rev. 1990; 5(3): 163-187.

Felgner, PL., et al., Lipofection: a highly efficient, lipid-mediated DNA-transfection procedure. Proc Natl Acad Sci U SA. Nov. 1987;84(21):7413-7.

Fernandez et al., Unusual base pairing during the decoding of a stop codon by the ribosome. Nature. Aug. 1, 2013;500(7460):107-10. doi: 10.1038/nature12302. Epub Jun. 30, 2013.

Fuke et al., Role of poly (A) tail as an identity element for mRNA nuclear export, Nucleic Acids Research, 2008, vol. 36 No. 3, pp. 1037-1049.

Fynan E.F. et al., DNA vaccines: protective immunizations by parenteral, mucosal, and gene-gun inoculations. Proc Natl Acad Sci US A. Dec. 15, 1993;90(24):11478-82.

Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.

Graf, M. et al., Codon-optimized genes that enable increased heterologous expression in mammalian cells and elicit efficient immune responses in mice after vaccination of naked DNA. Methods Mol Med. 2004;94:197-210.

Granstein, R.D. et al., Induction of anti-tumor immunity with epidermal cells pulsed with tumor-derived RNA or intradermal administration of RNA. J Invest Dermatol. Apr. 2000;114(4):632-6.

Grosjean, H., Modification and editing of RNA: historical overview and important facts to remember. Fine-tuning of RNA functions by modification and editing. Topics Curr Gen. Jan. 2005; 12: 1-22.

Harris, J. et al., An improved RNA amplification procedure results in increased yield of autologous RNA transfected dendritic cell-based vaccine. Biochim Biophys Acta. Jun. 20, 2005;1724(1-2):127-36. Epub Apr. 7, 2005.

Hecker et al., Non-Viral DNA and mRNA Gene Delivery to the CNS Pre-Operatively for Neuroprotection and Following Neurotrauma. Molecular Therapy. 2004; 9, S258-S258.

Heidenreich, O. et al., Chemically modified RNA: approaches and applications. FASEB J. Jan. 1993;7(1):90-6.

(56) References Cited

OTHER PUBLICATIONS

Heilman, KL et al., Internal 6-methyladenine residues increase the in vitro translation efficiency of dihydrofolate reductase messenger RNA. Int J Biochem Cell Biol. Jul. 1996; 28(7): 823-829.
Heiser, A. et al., Autologous dendritic cells transfected with prostate-specific antigen RNA stimulate CTL responses against metastatic prostate tumors. J Clin Invest. Feb. 2002;109(3):409-17.
Hoerr, I. et al., In vivo application of RNA leads to induction of specific cytotoxic T lymphocytes and antibodies. EurJ Immunol. Jan. 2000;30(1):1-7.
Hoerr, I. et al., Stabilized Messenger RNA (RNActiveTM) as a Tool for Innovative Gene Delivery. Tissue Engineering. Apr. 2007; 13(4): 865-925.
Hoerr, More than a messenger: A new class of drugs-mRNA-based therapeutics. Genetic Engineering & Biotechnology News. Jun. 18, 2013. http://www.genengnews.com/gen-articles/more-than-a-messenger-a-new-class-of-drugs-mrna-based-therapeutics/4916/ [last accessed Mar. 25, 2016].
Holtkamp, S. et al., Modification of antigen-encoding RNA increases stability, translational efficacy, and T-cell stimulatory capacity of dendritic cells. Blood. Dec. 15, 2006;108(13):4009-17.
Huddleston, J.A. et al., The sequence of the nucleoprotein gene of human influenza A virus, strain A/NT/60/68. Nucleic Acids Res. Feb. 11, 1982;10(3):1029-38.
Ivanovska, N. et al., Immunization with a DNA chimeric molecule encoding a hemagglutinin peptide and a scFv CD21-specific antibody fragment induces long-lasting IgM and CTL responses to influenza virus. Vaccine. Mar. 10, 2006;24(11 ):1830-7. Epub Nov. 2, 2005.
Iwasaki, A. et al., Enhanced CTL responses mediated by plasmid DNA immunogens encoding costimulatory molecules and cytokines. J lmmunol. May 15, 1997;158(10):459-601.
Kabanov, A.V. et al., A new class of antivirals: antisense oligonucleotides combined with a hydrophobic substituent effectively inhibit influenza virus reproduction and synthesis of virus-specific proteins in MOCK cells. FEBS Lett. Jan. 1, 1990 ;259(2):327-30.
Kallen et al., A novel, disruptive vaccination technology: self-adjuvanted RNActive(®) vaccines. Hum Vaccin Immunother. Oct. 2013;9(10):2263-76. doi: 10.4161/hv.25181. Epub Jun. 4, 2013. Review.
Kanaya, S. et al., Codon usage and tRNA genes in eukaryotes: correlation of codon usage diversity with translation efficiency and with CG-dinucleotide usage as assessed by multivariate analysis. J Mol Evol. Oct.-Nov. 2001;53(4-5):290-8.
Karijolich et al., Converting nonsense codons into sense codons by targeted pseudouridylation. Nature. Jun. 15, 2011;474(7351):395-8. doi: 10.1038/nature10165.
Kariko et al. Naturally occurring nucleoside modifications suppress the immunostimulatory activity of RNA: Implication for therapeutic RNA development. Current Opinion in Drug Discovery & Development 2007 10(5) 523-532; The Thomson Corporation ISSN 1367-6733.
Kariko et al., Generating the optimal mRNA for therapy: HPLC purification eliminates immune activation and improves translation of nucleoside-modified, protein-encoding mRNA, Nucleic Acids Research, Oxford University Press, GB, vol. 39, No. 21, Sep. 2, 2011 (Sep. 2, 2011), e142. doi: 10.1093/nar/gkr695. Epub Sep. 2, 2011.
Kariko et al., Impacts of Nucleoside Modification on RNA-mediated activation of toll-like receptors, 2008, Nucleic Acids in Innate Immunity, No vol., pp. 171-188.
Kariko et al., Phosphate-enhanced transfection of cationic lipid-complexed mRNA and plasmid DNA. Biochimica et Biophysica Acta. 1998. 1369:320-34.
Kariko, K. et al., Incorporation of pseudouridine into mRNA yields superior nonimmunogenic vector with increased translational capacity and biological stability. Mol Ther. Nov. 2008; 16(11):1833-40. Epub Sep. 16, 2008.
Kariko, K. et al., Suppression of RNA recognition by Toll-like receptors: the impact of nucleoside modification and the evolutionary origin of RNA. Immunity. Aug. 2005;23(2):165-75.
Kariko, K., et al., In vivo protein expression from mRNA delivered into adult rat brain. J. of Neuroscience Methods. Jan. 2001; 105(1): 77-86.
Kariko, K., et al., Increased erythropoiesis in mice injected with submicrogram quantities of pseudouridine-containing mRNA encoding erythropoietin. Mol Ther. May 2012; 20(5): 948-953.
Klinman, D.M. et al., DNA vaccines: safety and efficacy issues. Springer Semin lmmunopathol. 1997;19(2):245-56.
Kore et al., Synthesis and biological validation of $N^7$-(4-chlorophenoxyethyl) substituted dinucleotide cap analogs for mRNA translation. Bioorg Med Chem. Aug. 1, 2013;21(15):4570-4. doi:10.1016/j.bmc.2013.05.041. Epub Jun. 1, 2013.
Kormann, M. et al. Expression of therapeutic proteins after delivery of chemically modified mRNA in mice. Nat Biotechnol. Feb. 2011;29(2):154-7.
Kozak, Regulation of translation via mRNA structure in prokaryotes and eukaryotes, Gene 361 (2005), pp. 13-37.
Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, vol. 8, No. 4, pp. 3232-3241.
Kreiter et al., Intranodal vaccination with naked antigen-encoding RNA elicits potent prophylactic and therapeutic antitumoral immunity. Cancer Res. Nov. 15, 2010;70(22):9031-40. doi: 10.1158/0008-5472.CAN-10-0699. Epub Nov. 2, 2010.
Kreiter, S., et al., Tumor vaccination using messenger RNA: prospects of a future therapy. Curr Opinion in lmmun. Jun. 2011; 23(3): 399-406.
Kudla, G. et al., High guanine and cytosine content increases mRNA levels in mammalian cells. PLoS Biol. Jun. 2006;4(6):e180. Epub May 23, 2006.
Kuhn, A.N., et al., mRNA as a versatile tool for exogenous protein expression. Current Gene Therapy. Oct. 2012; 12 (5): 347-361.
Kusakabe, K. et al., The timing of GM-CSF expression plasmid administration influences the Th1/Th2 response induced by an HIV-1-specific DNA vaccine. J lmmunol. Mar. 15, 2000;164(6):3102-11.
Kwong, P. et al., Broadly Neutralizing Antibodies and the Search for an HIV-1 Vaccine: The End of the Beginning, Nature Reviews, immunology, vol. 13, Sep. 2013, pp. 693-701.
Laursen et al., Broadly Neutralizing Antibodies Against Influenza Viruses, Antiviral Research, 2013, vol. 98, no number, pp. 476-483.
Lee et al., Lipid Nanoparticle siRNA Systems for Silencing the Androgen Receptor in Human Prostate Cancer in Vivo, International Journal of Cancer, 2012, vol. 131, pp. 781-790.
Leitner, W.W. et al., DNA and RNA-based vaccines: principles, progress and prospects. Vaccine. Dec. 10, 1999;18 (9-10):765-77.
Lewis, Dynamic Polyconjugates (DPC) Technology: An elegant solution to the siRNA delivery problem. Arrowhead Research Corp (NASDAQ: ARWR). Nov. 2011.
Li, L. et al., Overcoming obstacles to develop effective and safe siRNA therapeutics. Expert Opin Biol Ther. May 2009; 9(5): 609-19.
Li, L. et al., Preparation and gene delivery of alkaline amino acids-based cationic liposomes. Arch Pharm Res. Jul. 2008;31(7):924-31. Epub Aug. 14, 2008.
Lian, et al., Trends and developments in liposome drug delivery systems. J Pharm Sci. Jun. 2001;90(6):667-80.
Limberis, Met al., Intranasal Antibody Gene Transfer in Mice and Ferrets Elicits Broad Protection Against Pandemic Influenza, Science Transl Med vol. 5, Issue 187, 99. 1-8.
Lorenzi, J.C., et al., Intranasal vaccination with messenger RNA as a new approach in gene therapy: Use against tuberculosis. BMC Biotechnol. Oct. 2010; 10(77): 1-11.
Luo, D. et al., Synthetic DNA delivery systems. Nat Biotechnol. Jan. 2000;18(1):33-7.
Ma, B. et al., HPV pseudovirions as DNA delivery vehicles. Ther Deliv. Apr. 2011; 2(4): 427-430.

(56) References Cited

OTHER PUBLICATIONS

Mackey et al., mRNA-based cancer vaccine: prevention of B16 melanoma progression and metastasis by systemic injection of MART1 mRNA histidylated lipopolyplexes, Cancer Gene Therapy, 2007, 14, pp. 802-814.

Magee, W.E. et al., Marked stimulation of lymphocyte-mediated attack on tumor cells by target-directed liposomes containing immune RNA, Cancer Res., 1978, 38(4):1173-6.

Malone, R.W. et al., Cationic liposome-mediated RNA transfection. Proc Natl Acad Sci U SA. Aug. 1989;86 (16):6077-81.

Marć et al., Nucleic acid vaccination strategies against infectious diseases. Expert Opin Drug Deliv. 2015;12(12):1851-65. doi:10.1517/17425247.2015.1077559. Epub Sep. 12, 2015.

Martinon, F. et al., Induction of virus-specific cytotoxic T lymphocytes in vivo by liposome-entrapped mRNA. EurJ lmmunol. Jul. 1993;23(7):1719-22.

Matray, T.J. et al., Synthesis and properties of RNA analogs-oligoribonucleotide N3'-->P5' phosphoramidates. Nucleic Acids Res. Oct. 15, 1999;27(20):3976-85.

Matsuda et al., Determinants of Initiation Codon Selection During Translation in Mammalian Cells, PLOS One, 2010, vol. 5, Issue 11, pp. 1-13.

Maurer, N., et al., Spontaneous entrapment of polynucleotides upon electrostatic interaction with ethanol-destabilized cationic liposomes. Biophys J. May 2001; 80(5): 2310-2326.

Midoux et al., Lipid-based mRNA vaccine delivery systems. Expert Rev Vaccines. Feb. 2015;14(2):221-34. doi: 10.1586/14760584.2015.986104. Epub Dec. 26, 2014. Review.

Mignone, et al., Untranslated regions of mRNAs. Genome Biol. 2002;3(3):REVIEWS0004. Epub Feb. 28, 2002. pp. 1-10.

Nagata, Synthesis and Biological Activity of Artificial mRNA Prepared with Novel Phosphorylating Reagents, Nucleic Acids Research, 2010, vol. 38, No. 21, pp. 7845-7857.

Nagata, T. et al., Codon optimization effect on translational efficiency of DNA vaccine in mammalian cells: analysis of plasmid DNA encoding a CTL epitope derived from microorganisms. Biochem Biophys Res Commun. Aug. 2, 1999;261 (2):445-51.

Nair, S. et al., Soluble proteins delivered to dendritic cells via pH-sensitive liposomes induce primary cytotoxic T lymphocyte responses in vitro. J Exp Med. Feb. 1, 1992;175(2):609-12.

Painter, H., et al., 494. Topical delivery of mRNA to the murine lung and nasal epithelium. Mol Ther. 2004; 9: S187.

Palese, P., Making Better influenza Virus Vaccines?, Emerging Infectious Diseases, vol. 12, No. 1 Jan. 2006, pp. 61-65.

Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.

Pascolo, S. Vaccination with messenger RNA (mRNA). Handb Exp Pharmacol. 2008; 183:221-235.

Pearson, W.R. et al., Improved tools for biological sequence comparison. Proc Natl Acad Sci USA. Apr. 1988;85 (8):2444-8.

Peculis, B. RNA processing: pocket guides to ribosomal RNA. Curr Biol. Aug. 1, 1997;7(8):R480-2.

Petsch et al., Protective efficacy of in vitro synthesized, specific mRNA vaccines against influenza A virus infection. Nat Biotechnol. Dec. 2012;30(12):1210-6. doi: 10.1038/nbt.2436. Epub Nov. 25, 2012.

Pollard, et al., Type I IFN counteracts the induction of antigen-specific immune responses by lipid-based delivery of mRNA vaccines. Mol Ther. Jan. 2013; 21 (1): 251-259.

Probst, J., et al., Spontaneous cellular uptake of exogenous messenger RNA in vivo is nucleic acid-specific, saturable and ion dependent. Gene Therapy. 2007; 14: 1175-1180.

Rammensee, H.G. et al., Peptides naturally presented by MHC class I molecules. Annu Rev lmmunol. 1993; 11 :213-44.

Read, M.L., et al., A versatile reducible polycation-based system for efficient delivery of a broad range of nucleic acids. Nucleic Acids Res. 2005; 33(9): e86.

Rejman, J., et al., mRNA transfection of cervical carcinoma and mesenchymal stem cells mediated by cationic carriers. J Controlled Rel. Nov. 2010; 147(3): 385-391.

Ren et al., Full genome of influenza A (H7N9) virus derived by direct sequencing without culture. Emerg Infect Dis. Nov. 2013;19(11):1881-4. doi:10.3201/eid1911.130664.

Reyes-Sandoval, A. et al., DNA Vaccines. Curr Mol Med. May 2001;1(2):217-43.

Rittig et al., Intradermal vaccinations with RNA coding for TAA generate CD8+ and CD4+ immune responses and induce clinical benefit in vaccinated patients. Mol Ther. May 2011;19(5):990-9. doi: 10.1038/mt.2010.289. Epub Dec. 28, 2010.

Robbins, et al., 2'-O-methyl-modified RNAs Act as TLR7 Antagonists, Molecular Therapy, 2007, vol. 15, No. 9, pp. 1663-1669.

Robinson, F. et al., Expression of human nPTB is limited by extreme suboptimal codon content. PLoS One. Mar. 12, 2008;3(3):e1801.

Robinson, H.L. et al., Protection against a lethal influenza virus challenge by immunization with a haemagglutinin-expressing plasmid DNA. Vaccine. 1993;11(9):957-60.

Rock, KL et al., A new foreign policy: MHC class I molecules monitor the outside world. lmmunol Today. Mar. 1996;17(3):131-7.

Ross, J. Control of messenger RNA stability in higher eukaryotes. Trends Genet. May 1996;12(5):171-5.

Rozenski et al., The RNA Modification Database: 1999 update. Nucleic Acids Res. Jan. 1, 1999;27(1):196-7.

Saenz-Badillos, J. et al., RNA as a tumor vaccine: a review of the literature. Exp Dermatol. Jun. 2001;10(3):143-54.

Satz, M.L. et al., Mechanism of immune transfer by RNA extracts. Immune RNA induces the synthesis of idiotype-bearing antigen receptors in noncommitted cells. Mol Cell biochem. Dec. 16, 1980;33(3):105-13.

Scheel, B. et al., lmmunostimulating capacities of stabilized RNA molecules. Eur J lmmunol. Feb. 2004;34(2):537-47.

Schirrmacher, V. et al., Intra-pinna anti-tumor vaccination with self-replicating infectious RNA or with DNA encoding a model tumor antigen and a cytokine. Gene Ther. Jul. 2000;7(13):1137-47.

Semple, et al., Rational design of cationic lipids for siRNA delivery. Nat Biotechnol. Feb. 2010;28(2): 172-176.

Sharp, J.S. et al., Effect of translational signals on mRNA decay in Bacillus subtilis. J Bacteriol. Sep. 2003;185 (18):5372-9.

Squires, et al., Widespread occurrence of 5-methylcytosine in human coding an non-coding RNC, Nucleic Acids Research, 2012, vol. 40, No. 11, pp. 5023-5033.

Steel, John et al., influenza Virus Vaccine Based on the Conserved Hemagglutinin Stalk Domain, mBio, 2010, vol. 1, Issue 1, pp. 1-10.

Strobel, I. et al., Human dendritic cells transfected with either RNA or DNA encoding influenza matrix protein M1 differ in their ability to stimulate cytotoxic T lymphocytes. Gene Ther. Dec. 2000; 7(23): 2028-2035.

Sullenger, BA et al., Emerging clinical applications of RNA. Nature. Jul. 11, 2002;418(6894):252-8.

Tavernier, G., et al., mRNA as gene therapeutic: How to control protein expression. J. of Controlled Release. Mar. 2011; 150(3): 238-247.

Teufel, R. et al., Human peripheral blood mononuclear cells transfected with messenger RNA stimulate antigen-specific cytotoxic T-lymphocytes in vitro. Cell Mol Life Sci. Aug. 2005;62(15):1755-62.

Torchilin, Vladimir et al., Multifunctional and Stimuli-Sensitive Pharmaceutical Nanocarriers, Eur J. Pharm Biopharm, 2009, vol. 71, No. 3, pp. 431-444.

Tracy, M., "Progress in the Development of LNP Delivery for siRNA Advancing LNPs to the Clinic," International Liposome Research Days Meeting, Vancouver, Canada. Aug. 2010, pp. 1-52.

Trojan, A. et al., Immune reactivity against a novel HLA-A3-restricled influenza virus peptide identified by predictive algorithms and interferon-gamma quantitative PCR. J lmmunother. Jan.-Feb. 2003;26(1):41-6.

Ueda, et al., Phosphorothioate-containing RNAs show mRNA activity in the prokaryotic translation systems in vitro. Nucleic Acids Res. Feb. 11, 1991 ;19(3):547-52.

(56) References Cited

OTHER PUBLICATIONS

Ulmer, J.B. et al., Heterologous protection against influenza by injection of DNA encoding a viral protein. Science. Mar. 19, 1993;259(5102):1745-9.

Uzgun, S., et al., PEGylation improves nanoparticle formation and transfection efficiency of messenger RNA. Pharm Res. Sep. 2011; 28(9); 2223-2232.

Van Tendeloo, V.F., et al., mRNA-based gene transfer as a tool for gene and cell therapy. Curr Opin Mol Therapeutics. 2007; 9(5): 423-431.

Vassilev, V.B. et al., Microparticle-mediated RNA immunization against bovine viral diarrhea virus. Vaccine. Feb. 28, 2001;19(15-16):2012-9.

Wan et al., Lipid nanoparticle delivery systems for siRNA-based therapeutics. Drug Deliv Transl Res. Feb. 2014;4(1):74-83. doi:10.1007/s13346-013-0161-z.

Wang et al., Systemic delivery of modified mRNA encoding herpes simplex virus 1 thymidine kinase for targeted cancer gene therapy. Mol Ther. Feb. 2013;21(2):358-67. doi: 10.1038/mt.2012.250. Epub Dec. 11, 2012.

Wei, et al. Induction of Broadly Neutralizing H1N1 influenza Antibodies by Vaccination, Science vol. 329, (2010) pp. 1060-1064.

Weide, B., et al., Direct injection of protamine-protected mRNA: Results of a phase 1/2 vaccination trial in metastatic melanoma patients. J. of Immunotherapy. Jun. 2009; 32(5): 498-507.

Weilhammer et al., The use of nanolipoprotein particles to enhance the immunostimulatory properties of innate immune agonists against lethal influenza challenge. Biomaterials. Dec. 2013;34(38):10305-18. doi: 10.1016/j.biomaterials.2013.09.038. Epub Sep. 27, 2013.

Wohlbold et al., An H10N8 influenza virus vaccine strain and mouse challenge model based on the human isolate A/Jiangxi-Donghu/346/13. Vaccine. Feb. 25, 2015;33(9):1102-6. doi: 10.1016/j.vaccine.2015.01.026. Epub Jan.17, 2015.

Wong et al., An mRNA vaccine for influenza. Nat Biotechnol. Dec. 2012;30(12):1202-4. doi: 10.1038/nbt.2439.

World Health Organization, Department of Communicable Disease Surveillance and Response, WHO/CSR, 2006, pp. 1-90.

World Health Organization, Serological Diagnosis of Influenza by Microneutralization Assay, 2010, No vol., pp. 1-25.

World Health Organization, WHO Manual on Animal Influenza Diagnosis and Surveillance, WHO Global Influenza Programme, CDS, CSR, NCS, 2002, vol. 5, No Number, pp. 1-99.

Wu, L. et al., Fusion protein vectors to increase protein production and evaluate the immunogenicity of genetic vaccines. Mol Ther. Sep. 2000;2(3):288-97.

Yamamoto, A., et al., Current prospects for mRNA gene delivery. Eur J Pharm Biopharm. Mar. 2009; 71 (3): 484-489.

Zohra, et al., Drastic effect of nanoapatite particles on liposome-mediated mRNA delivery to mammalian cells. Analytical Biochem. Oct. 2005; 345(1): 164-166.

Third Party Observation for International Application No. PCT/US2015/027400 submitted Aug. 22, 2016.

Geall et al., Nonviral delivery of self-amplifying RNA vaccines. Proc Natl Acad Sci U S A. Sep. 4, 2012;109(36):14604-9. doi:10.1073/pnas.1209367109.

Marzi et al., Vaccines. An Ebola whole-virus vaccine is protective in nonhuman primates. Science. Apr. 24, 2015;348(6233):439-42. doi:10.1126/science.aaa4919. Epub Mar. 26, 2015.

U.S. Appl. No. 15/174,594, filed Jun. 6, 2016, Bancel et al.

PCT/US2015/027400, Aug. 22, 2016, Third Party Observation.

U.S. Appl. No. 15/089,050, filed Apr. 1, 2016, Ciaramella et al.

[No Author Listed], Moderna Announces Positive Interim Phase 1 Clinical Data Demonstrating First mRNA Vaccine Candidate, mRNA-1440, Induces High Levels of Immunogenicity. Moderna Press Release. Apr. 27, 2017. 5 pages.

Bahl et al., Preclinical and Clinical Demonstration of Immunogenicity by mRNA Vaccines against H10N8 and H7N9 Influenza Viruses. Mol Ther. Jun. 7, 2017;25(6):1316-1327. doi: 10.1016/j.ymthe.2017.03.035. Epub Apr. 27, 2017.

Bogers et al., Potent immune responses in rhesus macaques induced by nonviral delivery of a self-amplifying RNA vaccine expressing HIV type 1 envelope with a cationic nanoemulsion. J Infect Dis. Mar. 15, 2015;15;211(6):947-55. doi: 10.1093/infdis/jiu522. Epub Sep. 18, 2014.

Fleeton et al., Self-replicative RNA vaccines elicit protection against influenza A virus, respiratory syncytial virus, and a tickborne encephalitis virus. J Infect Dis. May 1, 2001;183(9):1395-8. Epub Mar. 30, 2001.

Hekele et al., Rapidly produced SAM(®) vaccine against H7N9 influenza is immunogenic in mice. Emerg Microbes Infect. Aug. 2013;2(8):e52. doi: 10.1038/emi.2013.54. Epub Aug. 14, 2013.

Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.

MacLachlan, Lipid Nanoparticle-mediated delivery of messenger RNA. Presentation. 1st International mRNA Health Conference. Tubingen, Germany. Oct. 24, 2013. http://files.shareholder.com/downloads/ABEA-50QJTB/2628241206x0x699789/47543d12-db34-4e6e-88a9-f3ae5d97b1d2/MacLachlan_mRNA_Conf_2013.pdf. Last accessed Dec. 22, 2016.

Madden et al., Systemic delivery of mRNA therapeutics using lipid nanoparticles (LNP): improved potency for novel LNP and influence of route of administration on protein expression. 2nd International mRNA Health Conference. Nov. 12, 2014. https://acuitastx.com/wp-content/uploads/2015/01/Poster-Second-International-mRNA-Health-Conference.pdf. 1 page.

Magini et al., Self-Amplifying mRNA Vaccines Expressing Multiple Conserved Influenza Antigens Confer Protection against Homologous and Heterosubtypic Viral Challenge. PLoS One. Aug. 15, 2016;11(8):e0161193. doi: 10.1371/journal.pone.0161193. eCollection 2016.

Pascolo, Messenger RNA-based vaccines. Expert Opin Biol Ther. Aug. 2004;4(8):1285-94.

Phua et al., Messenger RNA (mRNA) nanoparticle tumour vaccination. Nanoscale. Jul. 21, 2014;6(14):7715-29. doi: 10.1039/c4nr01346h. Review.

Richner et al., Modified mRNA Vaccines Protect against Zika Virus Infection. Cell. Mar. 23, 2017;169(1):176. doi: 10.1016/j.cell.2017.03.016.

Rockoff, Startup Moderna Shows Promis in Vaccine Trial. The Wall Street Journal. Apr. 27, 2017. 2 pages.

Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.

GenBank Accession No. HQ244415.1, "Influenza A virus (A/goose/Czech Republic/1848-T14/2009 (H7N9) segment 4 hemagglutinin (HA) gene, complex cds," 2010.†

GenBank Accession No. GQ290464.1, "Influenza A virus (A/enviroment/Dongting Lake/Hunan/3-9/2007(H10N8)) segment 4 hemagglutinin (HA) gene, complete cds," 2011.†

\* cited by examiner
† cited by third party

Patterns of positional modification

| A | (L) | B | (L) | C | (L) |
|---|---|---|---|---|---|

5′[NNNNN$_n$]$_x$ L1 [NNNNNNNNNNNN$_o$]$_y$ L2 [XXXXXXXXXXX$_p$]$_z$ L3 3′

5′[NNNNN$_n$]$_x$ L1 [XXXXXXXXXXXXX$_o$]$_y$ L2 [XXXXXXXXXXX$_p$]$_z$ L3 3′

5′[XXXXXX$_n$]$_x$ L1 [XXXXXXXXXXXXX$_o$]$_y$ L2 [XXXXXXXXXXX$_p$]$_z$ L3 3′

5′[NNNNN$_n$]$_x$ L1 [NNNNNNNNNNNN$_o$]$_y$ L2 [XXXXXXXXXXX$_p$]$_z$ L3 3′

A, B, C- Region or Part of chimeric polynucleotide
N-nucleoside
n, o, p-number of nucleosides
x, y, z-number of regions
X-selective placement nucleoside
L-linker (optional)

FIGURE 4

Blocked or structured 3′ termini

| A | (L) | B | (L) | C | (L) |
|---|---|---|---|---|---|

5′[NNNN$_n$]$_x$ L1 [NNNNNNNNNNNN$_o$]$_y$ L2 [XXXXXXXXXXX$_p$]$_z$ L3 3′

5′[NNNN$_n$]$_x$ L1 [NNNNNNNNNNNN$_o$]$_y$ L2 [XXXXXXXXXXX$_p$]$_z$ K 3′

5′[NNNN$_n$]$_x$ L1 [NNNNNNNNNNNN$_o$]$_y$ L2 [XXXXXXXXXXXXXXX $^X_X$

3′ [XXXXXXXXXXX $^X$

5′[NNNNN$_n$]$_x$ L1 [NNNNNNNNNNNN$_o$]$_y$ L2 [XXXXXXXXXXXXXX$\begin{matrix}L_L\\L^L\end{matrix}$ =L3

3′XXXXXXXXXXX

5′[NNNNN$_n$]$_x$ L1 [NNNNNNNNNNNN$_o$]$_y$ L2 [XXXXXXXXXXXXXX$\begin{matrix}L_L\\L^L\end{matrix}$ =L3

$_X$ X XXXXXXXXXXX $^X$ X XXXXXXXXXXX 3′

A, B, C- Region or Part of chimeric polynucleotide
N-nucleoside
n, o, p-number of nucleosides
x, y, z-number of regions
X-selective placement nucleoside
K-non-nucleosidic moiety or conjugate
L-linker (optional)

| | | |
|---|---|---|
| AHZ41929 | A/mallard/Sweden/1621/2002(H7N9) | ..........V....I........................................V.... |
| AAY46211 | A/mallard/Sweden/91/2002(H7N9) | ..........V....I........................................V.... |
| AGY42258 | A/mallard/Sweden/91/2002(H7N9) | -------...V....I........................................V.... |
| AGE08098 | A/northern shoverl/Mississippi/11OS145/2011(H7N9) | ......TLIACML.GAKG..........A.............I..........TA..KK.. |
| AGR49734 | A/pigeon/Shanghai/S1069/2013(H7N9) | ............................................................. |
| ACD03594 | A/ruddy turnstone/DE/1538/2000(H7N9) | ......A.IACMLVGVRG..........A...........K.I..........SA..KK.. |
| AFX85260 | A/ruddy turnstone/Delaware Bay/220/1995(H7N9) | ......A.IACML.GI.G..........A.............I..........TA..K... |
| AHZ42549 | A/ruddy turnstone/Delaware/AI00-1538/2000(H7N9) | ......A.IACMLVGVRG..........A...........K.I..........SA..KK.. |
| AJJ94194 | A/silkie chicken/Dongguan/1264/2014(H7N9) | ............................................................. |
| AJJ94206 | A/silkie chicken/Dongguan/1268/2014(H7N9) | ............................................................. |
| AJJ94344 | A/silkie chicken/Dongguan/1451/2014(H7N9) | ...............................................S............. |
| AJJ95584 | A/silkie chicken/Dongguan/1519/2014(H7N9) | ............................................................. |
| AJJ93845 | A/silkie chicken/Dongguan/157/2014(H7N9) | ............................................................. |
| AJJ90673 | A/silkie chicken/Dongguan/3049/2013(H7N9) | ..........T.................................................. |
| AJJ90795 | A/silkie chicken/Dongguan/3281/2013(H7N9) | ............................P................................ |
| AJJ90891 | A/silkie chicken/Dongguan/3520/2013(H7N9) | ............................................................. |
| AJJ91264 | A/silkie chicken/Dongguan/4129/2013(H7N9) | ............................................................. |
| AJJ93979 | A/silkie chicken/Dongguan/656/2014(H7N9) | ............................................................. |
| AJJ94959 | A/silkie chicken/Dongguan/967/2014(H7N9) | ............................................................. |
| AJJ92967 | A/silkie chicken/Jiangxi/9469/2014(H7N9) | .............V............................................... |
| AJJ97925 | A/silkie chicken/Shantou/2050/2014(H7N9) | ............................................................. |
| AJJ90538 | A/silkie chicken/Shenzhen/918/2013(H7N9) | ............................................................. |
| AEK84765 | A/spot-billed duck/Korea/447/2011(H7N9) | -----.....V.............................................V.... |
| AGW82588 | A/tree sparrow/Shanghai/01/2013(H7N9) | ............................................................. |
| ABI84694 | A/turkey/Minnesota/1/1988(H7N9) | ........IACVLVEAKG..........V...........K.I..........TA..GK.. |
| AHA11483 | A/turkey/Minnesota/14135-2/2009(H7N9) | ......ALIACML.GAKG..........A.............I..........TA.VKK.. |
| AHA57050 | A/turkey/Minnesota/14659/2009(H7N9) | ......ALIACML.GAKG..........A.............I..........TA.VKK.. |
| AHA57072 | A/turkey/Minnesota/18421/2009(H7N9) | ......ALIACML.GAKG..........A.............I..........TA.VKK.. |
| AHA11472 | A/turkey/Minnesota/31676/2009(H7N9) | ......ALIACML.GAKG..........A.............I..........TA.VKK.. |
| AHA11461 | A/turkey/Minnesota/31900/2011(H7N9) | ......ALIACMLVG.KG..........A.............I..........TA..KK.. |
| AHA11452 | A/turkey/Minnesota/32710/2011(H7N9) | ......ALIACMLVG.KG..........A.............I..........TA..KK.. |
| AAM19228 | A/turkey/Minnesota/38429/1988(H7N9) | ---------ACVLVEAKG..........V...........K.I..........TA..GK.. |
| ACZ48625 | A/turkey/Minnesota/38429/1988(H7N9) | ........IACVLVEAKG..........V...........K.I..........TA..GK.. |
| AEK84760 | A/wild bird/Korea/A14/2011(H7N9) | ------------------------------------------------------------- |
| AEK84761 | A/wild bird/Korea/A3/2011(H7N9) | ----......V.......N..G.......................F..........V.... |
| AEK84763 | A/wild bird/Korea/A9/2011(H7N9) | ----......V.......N..G......................FF.......P..V.... |
| AGG53377 | A/wild duck/Korea/CSM42-1/2011(H7N9) | ..........V.............................................V.... |
| AGG53366 | A/wild duck/Korea/CSM42-34/2011(H7N9) | ..........V.............................................V.... |
| AGG53432 | A/wild duck/Korea/MHC35-41/2011(H7N9) | ..........V.............................................V.... |
| AGG53399 | A/wild duck/Korea/MHC39-26/2011(H7N9) | ..........V.............................................V.... |

```
AJJ95464 A/chicken/Shenzhen/138/2014(H7N9)                   ....................................................
AJJ90576 A/chicken/Shenzhen/1665/2013(H7N9)                  ....................................................
AJJ90588 A/chicken/Shenzhen/2110/2013(H7N9)                  ....................................................
AJJ91035 A/chicken/Shenzhen/3780/2013(H7N9)                  ....................................................
AJJ90490 A/chicken/Shenzhen/742/2013(H7N9)                   ....................................................
AJJ92005 A/chicken/Shenzhen/801/2013(H7N9)                   ....................................................
AJJ90526 A/chicken/Shenzhen/898/2013(H7N9)                   ....................................................
AIU47013 A/chicken/Suzhou/040201H/2013(H7N9)                 ....................................................
AGJ72861 A/chicken/Zhejiang/DTID-ZJU01/2013(H7N9)            ....................................................
AIU46619 A/chicken/Zhejiang/DTID-ZJU06/2013(H7N9)            ....................................................
AGR49554 A/chicken/Zhejiang/SD033/2013(H7N9)                 ....................................R...............
AGR49566 A/duck/Anhui/SC702/2013(H7N9)                       ....................................................
BAN16711 A/duck/Gunma/466/2011(H7N9)                         ......M.......................N.....R.........D.....
AJJ97841 A/duck/Jiangxi/15044/2014(H7N9)                     ....................................................
AGQ80952 A/duck/Jiangxi/3096/2009(H7N9)                      ......M.......................N.....R...............
AGQ80989 A/duck/Jiangxi/3257/2009(H7N9)                      ......M.......................N.....R...............
BAH22785 A/duck/Mongolia/119/2008(H7N9)                      ......M.......................N.....................
BAN59727 A/duck/Mongolia/129/2010(H7N9)                      ......M.......................N.....................
BAN59726 A/duck/Mongolia/147/2008(H7N9)                      ......M.......................N.....................
AJK00354 A/duck/Zhejiang/LS02/2014(H7N9)                     ......M.......................N.....................
AFM09439 A/emperor goose/Alaska/44063-061/2006(H7N9)         ......M.......................N.....RK..............
AFV33947 A/goose/Nebraska/17097-4/2011(H7N9)                 ......M..I....................N.....RK..............
AFV33945 A/guinea fowl/Nebraska/17096-1/2011(H7N9)           ......M..I....................N.....RK..............
AHA11441 A/guinea fowl/Nebraska/17096/2011(H7N9)             ......M..I....................N.....RK..............
AGR49722 A/homing pigeon/Jiangsu/SD184/2013(H7N9)            ....................................................
AGL97639 A/mallard/Minnesota/AI09-3770/2009(H7N9)            ......M..L....................N.....RK..............
AHZ42537 A/mallard/Minnesota/AI09-3770/2009(H7N9)            ......M..L....................N.....RK..............
ADC29485 A/mallard/Spain/08.00991.3/2005(H7N9)               ......M.......................N.....................
AHZ41929 A/mallard/Sweden/1621/2002(H7N9)                    ......M.......................N.....R...............
AAY46211 A/mallard/Sweden/91/2002(H7N9)                      ......M.......................N.....R...............
AGY42258 A/mallard/Sweden/91/2002(H7N9)                      ......M.......................N.....R...............
AGE08098 A/northern shoverl/Mississippi/11OS145/2011(H7N9)   ......M.......................N.....RK..............
AGR49734 A/pigeon/Shanghai/S1069/2013(H7N9)                  ....................................................
ACD03594 A/ruddy turnstone/DE/1538/2000(H7N9)                ......M.......................N.....RK..............
AFX85260 A/ruddy turnstone/Delaware Bay/220/1995(H7N9)       ......M.......................N.....RK..............
AHZ42549 A/ruddy turnstone/Delaware/AI00-1538/2000(H7N9)     ......M.......................N.....RK..............
AJJ94194 A/silkie chicken/Dongguan/1264/2014(H7N9)           ....................................................
AJJ94206 A/silkie chicken/Dongguan/1268/2014(H7N9)           ....................................................
AJJ94344 A/silkie chicken/Dongguan/1451/2014(H7N9)           ....................................................
```

```
Positions from 1 till 60
          Consensus sequence                                 MYKIVVIIALLGAVKGLDKICLGHHAVANGTIVKTLTNEQEEVTNATETVESTGLNRLCM
AHN97094  A/American green-winged teal/Ohio/13OS1869/2013(H10N8) .....LVL......H............P...........K............KS.DK...
AHM24205  A/Eurasian coot/Germany/R411/2010(H10N8)           .......VT.....R................T.....................S..K...
AHK10761  A/Jiangxi/IPB13/2013(H10N8)                        ......................................................I.....
AHK10763  A/Jiangxi/IPB13b/2013(H10N8)                       ......................................................I.....
AJD10539  A/chicken/Jiangxi/1204/2014(H10N8)                 ......................................................I.....
AJD11559  A/chicken/Jiangxi/1232/2014(H10N8)                 ...V..................................................I.....
AJD11571  A/chicken/Jiangxi/1270/2014(H10N8)                 ......................................................I.....
AJD11583  A/chicken/Jiangxi/1279/2014(H10N8)                 ......................................................I.....
AJD09903  A/chicken/Jiangxi/18399/2013(H10N8)                ............................................................
AJD09915  A/chicken/Jiangxi/18933/2013(H10N8)                ............................................................
AJD09927  A/chicken/Jiangxi/19924/2013(H10N8)                ............................................................
AJD09939  A/chicken/Jiangxi/19960/2013(H10N8)                ............................................................
AJD10551  A/chicken/Jiangxi/23252/2013(H10N8)                .......................................K....................
AJD10563  A/chicken/Jiangxi/23259/2013(H10N8)                .........................................K..................
AJD10575  A/chicken/Jiangxi/23274/2013(H10N8)                ......................................................I.....
AJD10587  A/chicken/Jiangxi/27600/2013(H10N8)                ....I.................................................I.....
AJD10611  A/chicken/Jiangxi/28113/2013(H10N8)                ......................................................I.....
AJD11595  A/chicken/Jiangxi/3152/2014(H10N8)                 ......................................................I.....
AJD10683  A/chicken/Jiangxi/34609/2013(H10N8)                ......................................................I.....
AJD11271  A/chicken/Jiangxi/36229/2013(H10N8)                ...V..................................................I.....
AIK26172  A/chicken/Jiangxi/JXA132717/2014(H10N8)            -----.................................................I.....
AFJ19053  A/duck/Guangdong/E1/2012(H10N8)                    ...........R.........................................S......
BAG16719  A/duck/Hokkaido/W95/2006(H10N8)                    ------------------------------------------------------------
AJD14343  A/duck/Jiangxi/2039/2005(H10N8)                    .....................................................S......
AJD14367  A/duck/Jiangxi/22960/2008(H10N8)                   ....................................................AS......
AJD14379  A/duck/Jiangxi/4759/2009(H10N8)                    ................................I...................AS......
AJD10887  A/duck/Jiangxi/6450/2013(H10N8)                    ............................................................
AJD10911  A/duck/Jiangxi/6474/2013(H10N8)                    ............................................................
AJD10923  A/duck/Jiangxi/6487/2013(H10N8)                    ................I...........................................
AJD10971  A/duck/Jiangxi/6526/2013(H10N8)                    ............................................................
AJD10995  A/duck/Jiangxi/6544/2013(H10N8)                    ...........................V................................
AJD11055  A/duck/Jiangxi/6602/2013(H10N8)                    ............................................................
AJD11091  A/duck/Jiangxi/6645/2013(H10N8)                    ................................................X...........
AIK26225  A/duck/Jiangxi/JXA132712/2014(H10N8)               ------................................................I.....
AIK26196  A/duck/Jiangxi/JXA132727/2014(H10N8)               -------...............................................I.....
AB052082  A/longtail duck/Maryland/295/2005(H10N8)           .....LVL......H............P...........K............KS.DK...
ADU16029  A/mallard/Interior Alaska/6MP0758/2006(H10N8)      .....LVL..F...H............P...........K............KS.DK...
```

FIGURE 23-1

```
AER09406    A/mallard/Korea/1041/2010(H10N8)                            ----------------------------------------------------KS......
AER09416    A/mallard/Korea/1203/2010(H10N8)                            ----------------------------------------------------KS.GK....
AHZ38995    A/mallard/Sweden/233/2002(H10N8)                            ...T.............................................N.S..K....
ADE75294    A/mallard/Sweden/7/2003(H10N8)                              .V...R..........................V...H..................S...
AJD14391    A/migratory duck/Jiangxi/21248/2009(H10N8)                  .......I.........................................S.........
AJD14355    A/migratory duck/Jiangxi/593/2005(H10N8)                    ....LVL........H.................S......K..........KS.DK...
ACK43693    A/northern pintail/California/44221-656/2006(H10N8)         ....PVL........H.................P......K...........GS.DK...
AEK49546    A/northern shoveler/California/9235/2008(H10N8)             ................................................S..K......
ACZ48518    A/quail/Italy/1117/1965(H10N8)                              ..V..R......................T...........T...........S..K...
ABI84499    A/quail/Italy/1117/1965(H10N8)                              ..V..R......................T...........T...........S..K...
AEA04419    A/quail/Italy/1117/1965(H10N8)                              .D.K.V......................T...........T.............S....
AGU01953    A/ruddy shelduck/Mongolia/1602/2010(H10N8)                  ....LVL........H.................P......K..........KS.DK...
AGL58508    A/ruddy turnstone/New Jersey/148668/2004(H10N8)             ....LVL........H.................S......K..........KN.D....
AGG28633    A/shorebird/Delaware Bay/379/2008(H10N8)                    .....V...........................................S.........
AGU01957    A/surf scoter/Mongolia/878V/2009(H10N8)                     .....V...........................................S.........
AGU01970    A/velvet scoter/Mongolia/879V/2009(H10N8)                   ................................................S.........

Positions from 61 till 120
Consensus sequence                                                      KGRKHKDLGNCHPIGMLIGTPACDLHLTGTWDTLIERENAIAYCYPGATVNEEALRQKIM
AHN97094    A/American green-winged teal/Ohio/130S1869/2013(H10N8)      .S.NY.........I...........D.S..............................
AHM24205    A/Eurasian coot/Germany/R411/2010(H10N8)                    R..SY...R....I.L..V.E....A.......................I..........
AHK10761    A/Jiangxi/IPB13/2013(H10N8)                                 ........................M.......................V..........
AHK10763    A/Jiangxi/IPB13b/2013(H10N8)                                ........................M.......................V..........
AJD10539    A/chicken/Jiangxi/1204/2014(H10N8)                          .................................................V..........
AJD11559    A/chicken/Jiangxi/1232/2014(H10N8)                          .................................................V..........
AJD11571    A/chicken/Jiangxi/1270/2014(H10N8)                          .................................................V..........
AJD11583    A/chicken/Jiangxi/1279/2014(H10N8)                          ...............................................A.V..........
AJD09903    A/chicken/Jiangxi/18399/2013(H10N8)                         .................................................V..........
AJD09915    A/chicken/Jiangxi/18933/2013(H10N8)                         ..............................................................
AJD09927    A/chicken/Jiangxi/19924/2013(H10N8)                         ..............................................................
AJD09939    A/chicken/Jiangxi/19960/2013(H10N8)                         ..........................S......................G...........
AJD10551    A/chicken/Jiangxi/23252/2013(H10N8)                         .................................................V..........
AJD10563    A/chicken/Jiangxi/23259/2013(H10N8)                         ..............................I...............................
AJD10575    A/chicken/Jiangxi/23274/2013(H10N8)                         .................................................V..........
AJD10587    A/chicken/Jiangxi/27600/2013(H10N8)                         .................................................V..........
AJD10611    A/chicken/Jiangxi/28113/2013(H10N8)                         .................................................V..........
AJD11595    A/chicken/Jiangxi/3152/2014(H10N8)                          ..........................................S.................
AJD10683    A/chicken/Jiangxi/34609/2013(H10N8)                         .................................................V..........
AJD11271    A/chicken/Jiangxi/36229/2013(H10N8)                         .................................................V..........
```

FIGURE 23-2

```
AIK26172   A/chicken/Jiangxi/JXA132717/2014(H10N8)                 ...................................................V........
AFJ19053   A/duck/Guangdong/E1/2012(H10N8)                         ...N.................T..................V................R..
BAG16719   A/duck/Hokkaido/W95/2006(H10N8)                         ------------------------------------------------------------
AJD14343   A/duck/Jiangxi/2039/2005(H10N8)                         ...S........................................................
AJD14367   A/duck/Jiangxi/22960/2008(H10N8)                        ...R......................................................V.
AJD14379   A/duck/Jiangxi/4759/2009(H10N8)                         ...R......................................................V.
AJD10887   A/duck/Jiangxi/6450/2013(H10N8)                         ...N........................................................
AJD10911   A/duck/Jiangxi/6474/2013(H10N8)                         ...N....................................T...................
AJD10923   A/duck/Jiangxi/6487/2013(H10N8)                         ...N........................................................
AJD10971   A/duck/Jiangxi/6526/2013(H10N8)                         ...N........................................................
AJD10995   A/duck/Jiangxi/6544/2013(H10N8)                         ...N........................................................
AJD11055   A/duck/Jiangxi/6602/2013(H10N8)                         ...N....................................T...................
AJD11091   A/duck/Jiangxi/6645/2013(H10N8)                         ...N........................................................
AIK26225   A/duck/Jiangxi/JXA132712/2014(H10N8)                    ...................................................V........
AIK26196   A/duck/Jiangxi/JXA132727/2014(H10N8)                    ...................................................V........
ABO52082   A/longtail duck/Maryland/295/2005(H10N8)                .N.NY..........VV....................D.S..........S.........
ADU16029   A/mallard/Interior Alaska/6MP0758/2006(H10N8)           .S.NY..........V.....................D.S....................
AER09406   A/mallard/Korea/1041/2010(H10N8)                        ------------------------------------------------------------
AER09416   A/mallard/Korea/1203/2010(H10N8)                        ...N.............................................I..........
AHZ38995   A/mallard/Sweden/233/2002(H10N8)                        ...SYN.........I........................V...................
ADE75294   A/mallard/Sweden/7/2003(H10N8)                          ...S.................V......................................
AJD14391   A/migratory duck/Jiangxi/21248/2009(H10N8)              ...N.............................................I..........
AJD14355   A/migratory duck/Jiangxi/593/2005(H10N8)                ...S........................................................
ACK43693   A/northern pintail/California/44221-656/2006(H10N8)     .S.NY..........V.....................D.S....................
AEK49546   A/northern shoveler/California/9235/2008(H10N8)         .S.NY..........V.....................D.S....................
ACZ48518   A/quail/Italy/1117/1965(H10N8)                          ...RY................V..................T......V.I..........
ABI84499   A/quail/Italy/1117/1965(H10N8)                          ...RY................V..................T......V.I..........
AEA04419   A/quail/Italy/1117/1965(H10N8)                          ...RY................V..................T......V.I..........
AGU01953   A/ruddy shelduck/Mongolia/1602/2010(H10N8)              ...N........................................................
AGL58508   A/ruddy turnstone/New Jersey/1148668/2004(H10N8)        .S.NY..........V.....................D.S....................
AGG28633   A/shorebird/Delaware Bay/379/2008(H10N8)                .N.NY....S.....V.....................D.S....................
AGU01957   A/surf scoter/Mongolia/878V/2009(H10N8)                 ...N.............................................I..........
AGU01970   A/velvet scoter/Mongolia/879V/2009(H10N8)               ...N.............................................I..........

Positions  from 121 till 180
           Consensus sequence                                      ESGGIDKISTGFTYGSSINSAGTTRACMRNGGNSFYAELKWLVSKSKGQNFPQTTNTYRN
AHN97094   A/American green-winged teal/Ohio/13OS1869/2013(H10N8)  ........................K....................N..............
AHM24205   A/Eurasian coot/Germany/R411/2010(H10N8)                ....VS.............P..V.K..L...QS......R.....TQ.............
AHK10761   A/Jiangxi/IPB13/2013(H10N8)                             ....N.......................................................
AHK10763   A/Jiangxi/IPB13b/2013(H10N8)                            ....N.......................................................
```

Positions from 301 till 360

| | Consensus sequence | RLPFQNLSPRTVGQCPKYVNKRSLMLATGMRNVPELMQGRGLFGAIAGFIENGWEGMVDG |
|---|---|---|
| AHN97094 | A/American green-winged teal/Ohio/13OS1869/2013(H10N8) | K.......................L..........VV....................... |
| AHM24205 | A/Eurasian coot/Germany/R411/2010(H10N8) | K.......................L..........V........................ |
| AHK10761 | A/Jiangxi/IPB13/2013(H10N8) | ....................R...............I............L.......... |
| AHK10763 | A/Jiangxi/IPB13b/2013(H10N8) | ....................R...............I............L.......... |
| AJD10539 | A/chicken/Jiangxi/1204/2014(H10N8) | K...................R...............I............L.......... |
| AJD11559 | A/chicken/Jiangxi/1232/2014(H10N8) | ....................R...............I............L.......... |
| AJD11571 | A/chicken/Jiangxi/1270/2014(H10N8) | ....................R...............I............L.......... |
| AJD11583 | A/chicken/Jiangxi/1279/2014(H10N8) | ....................R...............I............L.......... |
| AJD09903 | A/chicken/Jiangxi/18399/2013(H10N8) | .................................................L.......... |
| AJD09915 | A/chicken/Jiangxi/18933/2013(H10N8) | ....................................I............L.......... |
| AJD09927 | A/chicken/Jiangxi/19924/2013(H10N8) | .................................................L.......... |
| AJD09939 | A/chicken/Jiangxi/19960/2013(H10N8) | .................................................L.......... |
| AJD10551 | A/chicken/Jiangxi/23252/2013(H10N8) | .................................................L.......... |
| AJD10563 | A/chicken/Jiangxi/23259/2013(H10N8) | ....................................I............L.......... |
| AJD10575 | A/chicken/Jiangxi/23274/2013(H10N8) | ....................R...............I............L.......... |
| AJD10587 | A/chicken/Jiangxi/27600/2013(H10N8) | ....................R...............I............L.......... |
| AJD10611 | A/chicken/Jiangxi/28113/2013(H10N8) | ....................R...............I............L.......... |
| AJD11595 | A/chicken/Jiangxi/3152/2014(H10N8) | ....................R...............I............L.......... |
| AJD10683 | A/chicken/Jiangxi/34609/2013(H10N8) | ....................R...............I............L.......... |
| AJD11271 | A/chicken/Jiangxi/36229/2013(H10N8) | ....................R...............I............L.......... |
| AIK26172 | A/chicken/Jiangxi/JXA132717/2014(H10N8) | K...................RK..............I............L.......... |
| AFJ19053 | A/duck/Guangdong/E1/2012(H10N8) | K....................K.............IV.E..................... |
| BAG16719 | A/duck/Hokkaido/W95/2006(H10N8) | ------------------------------------------------------------ |
| AJD14343 | A/duck/Jiangxi/2039/2005(H10N8) | .....................K.............I........................ |
| AJD14367 | A/duck/Jiangxi/22960/2008(H10N8) | ...................................I........................ |
| AJD14379 | A/duck/Jiangxi/4759/2009(H10N8) | ...................................I........................ |
| AJD10887 | A/duck/Jiangxi/6450/2013(H10N8) | ............................................................ |
| AJD10911 | A/duck/Jiangxi/6474/2013(H10N8) | ............................................................ |
| AJD10923 | A/duck/Jiangxi/6487/2013(H10N8) | ............................................................ |
| AJD10971 | A/duck/Jiangxi/6526/2013(H10N8) | ............................................................ |
| AJD10995 | A/duck/Jiangxi/6544/2013(H10N8) | ............................................................ |
| AJD11055 | A/duck/Jiangxi/6602/2013(H10N8) | ............................................................ |
| AJD11091 | A/duck/Jiangxi/6645/2013(H10N8) | ............................................................ |
| AIK26225 | A/duck/Jiangxi/JXA132712/2014(H10N8) | ....................R...............I............L.......... |
| AIK26196 | A/duck/Jiangxi/JXA132727/2014(H10N8) | K...................RK..............I............L.......... |
| AB052082 | A/longtail duck/Maryland/295/2005(H10N8) | K....................K..L..........VA....................... |
| ADU16029 | A/mallard/Interior Alaska/6MP0758/2006(H10N8) | K....................K..L..........VV....................... |
| AER09406 | A/mallard/Korea/1041/2010(H10N8) | .....................K.............I........................ |
| AER09416 | A/mallard/Korea/1203/2010(H10N8) | .....................K.............I........................ |

| Accession | Strain | Sequence |
|---|---|---|
| AJD09903 | A/chicken/Jiangxi/18399/2013(H10N8) | ................................................ |
| AJD09915 | A/chicken/Jiangxi/18933/2013(H10N8) | ................................................ |
| AJD09927 | A/chicken/Jiangxi/19924/2013(H10N8) | ................................................ |
| AJD09939 | A/chicken/Jiangxi/19960/2013(H10N8) | ................................................ |
| AJD10551 | A/chicken/Jiangxi/23252/2013(H10N8) | ................................................ |
| AJD10563 | A/chicken/Jiangxi/23259/2013(H10N8) | ................................................ |
| AJD10575 | A/chicken/Jiangxi/23274/2013(H10N8) | ................................................ |
| AJD10587 | A/chicken/Jiangxi/27600/2013(H10N8) | ................................................ |
| AJD10611 | A/chicken/Jiangxi/28113/2013(H10N8) | ................................................ |
| AJD11595 | A/chicken/Jiangxi/3152/2014(H10N8) | ................................................ |
| AJD10683 | A/chicken/Jiangxi/34609/2013(H10N8) | ................................................ |
| AJD11271 | A/chicken/Jiangxi/36229/2013(H10N8) | ................................................ |
| AIK26172 | A/chicken/Jiangxi/JXA132717/2014(H10N8) | ................................................ |
| AFJ19053 | A/duck/Guangdong/E1/2012(H10N8) | ................................M............... |
| BAG16719 | A/duck/Hokkaido/W95/2006(H10N8) | ................................................ |
| AJD14343 | A/duck/Jiangxi/2039/2005(H10N8) | ................................M............... |
| AJD14367 | A/duck/Jiangxi/22960/2008(H10N8) | ................................................ |
| AJD14379 | A/duck/Jiangxi/4759/2009(H10N8) | ................................................ |
| AJD108877 | A/duck/Jiangxi/6450/2013(H10N8) | ................................................ |
| AJD10911 | A/duck/Jiangxi/6474/2013(H10N8) | ................................................ |
| AJD10923 | A/duck/Jiangxi/6487/2013(H10N8) | ................................

| Accession | Strain |
|---|---|
| AEA04419 | A/quail/Italy/1117/1965(H10N8) |
| AGU01953 | A/ruddy shelduck/Mongolia/1602/2010(H10N8) |
| AGL58508 | A/ruddy turnstone/New Jersey/1148868/2004(H10N8) |
| AGG28633 | A/shorebird/Delaware Bay/379/2008(H10N8) |
| AGU01957 | A/surf scoter/Mongolia/878V/2009(H10N8) |
| AGU01970 | A/velvet scoter/Mongolia/879V/2009(H10N8) |

Positions from 481 till 540
Consensus sequence

```
                                                              YHACDDSCMESIRNN

FIGURE 23-13

| | | |
|---|---|---|
| AJD11271 | A/chicken/Jiangxi/36229/2013(H10N8) | ..

NUCLEIC ACID VACCINES

RELATED APPLICATIONS

This application claims the benefit under 35 U.S.C. § 119 of U.S. provisional applications 61/983,250, filed Apr. 23, 2014 and 62/088,994, filed Dec. 8, 2014, the entire contents of each of which are incorporated herein by reference.

FIELD OF THE INVENTION

The invention relates to compositions, methods, processes, kits and devices for the selection, design, preparation, manufacture, formulation, and/or use of vaccines, specifically nucleic acid vaccines (NAVs). In particular, the invention relates to compositions, methods, processes, kits and devices for the selection, design, preparation, manufacture, formulation, and/or use of ribonucleic acid (RNA) vaccines, e.g., mRNA vaccines.

BACKGROUND OF THE INVENTION

Vaccination is an effective way to provide phrophylactic protection against infectious diseases, including, but not limited to, viral, bacterial, and/or parasitic diseases, such as influenza, AIDS, hepatotisis virus infection, cholera, malaria and tuberculosis, and many other diseases. For example, influenza infections are the seventh leading cause of death in the United States with 200,000 hospitalizations and 40,000 deaths seen in the United States per year and cause about 3-5 million hospitalizations and about 300,000 to 500,000 deaths worldwide per year Millions of people receive flu vaccines to protect them from seasonal flu each year. Vaccination can also rapidly prevent the spread of an emerging influenza pandemic.

A typical vaccine contains an agent that resembles a weakened or dead form of the disease-causing agent, which could be a microorganism, such as bacteria, virus, fungi, parasites, or one or more toxins and/or one or more proteins, for example, surface proteins, (i.e., antigens) of such a microorganism. The antigen or agent in the vaccine can stimulate the body's immune system to recognize the agent as a foreign invader, generate antibodies against it, destroy it and develop a memory of it. The vaccine-induced memory enables the immune system to act quickly to protect the body from any of these agents that it later encounters.

Vaccine production used in the art e.g., antigen vaccine production, has several stages, including the generation of antigens, antigen purification and inactivation, and vaccine formulation. First, the antigen is generated through culturing viruses in cell lines, growing bacteria in bioreactors, or producing recombinant proteins derived from viruses and bacteria in cell cultures, yeast or bacteria. Recombinant proteins are then purified and the viruses and bacteria are inactivated before they are formulated with adjuvants in vaccines. It has been a challenge to drastically reduce the time and expense associated with current technologies in vaccine development.

Another obstacle to the development of new vaccine is the constant evolution of most infectious agents, such as viruses and bacteria. Viruses often mutate their surface proteins to generate new antigens which can help them skipping the active immune system that has been immunized by vaccines containing the viruses. In contrast, bacteria acquire and mutate key proteins to evade host defense and effective antibiotic applications.

For example, influenza A, B and C viruses are the etiological agents of influenza. Hemagglutinin (HA), the major envelop glycoprotein of influenza A and B viruses, or its homologue, hemagglutinin-esterase (HE) in influenza C virus, is the natural reservoir of the viruses. The rapid evolution of the hemagglutinin (HA) protein of the influenza virus results in the constant emergence of new strains, rendering the adaptive immune response of the host only partially protective to new infections. The biggest challenge for therapy and prophylaxis against influenza and other infections using traditional vaccines is the limitation of vaccines in breadth, providing protection only against closely related subtypes. In addition, today's length of the production process inhibits any fast reaction to develop and produce an adapted vaccine in a pandemic situation.

It is of great interest to develop new vaccines as well as new approaches to combatting infectious disease and infectious agents.

SUMMARY OF THE INVENTION

Described herein are compositions, methods, processes, kits and devices for the selection, design, preparation, manufacture, formulation, and/or use of nucleic acid vaccines (NAVs). In particular, described herein are compositions, methods, processes, kits and devices for the selection, design, preparation, manufacture, formulation, and/or use of nucleic acid vaccines, e.g., RNA vaccines and mRNA vaccines.

The present invention provides compositions, e.g., pharmaceutical compositions, comprising one or more onucleic acid vaccines or NAVs.

The NAVs or NAV compositions or the invention may be designed to comprise one or more nucleic acid molecules, e.g., polynucleotides, which encode one or more wild type or engineered proteins, peptides or polypeptides (e.g., antigens). In some embodiments, the nucleic acid molecule, e.g., polynucleotide, is RNA. In some embodiments the nucleic acid molecule, e.g., polynucleotide, is an mRNA. In some embodiments the NAV or NAV composition comprises a nucleic acid (e.g., a RNA polynucleotide) which is chemically modified. In some embodiments the infectious agent from which the antigen is derived or engineered includes, but is not limited to viruses, bacteria, fungi, protozoa, and/or parasites.

In some embodiments are provided methods of inducing, eliciting, boosting or triggering an immune response in a cell, tissue or organism, comprising contacting said cell, tissue or organism with any of the RNAVs described or taught herein.

Aspects of the invention provide nucleic acid vaccines (NAVs) comprising one or more RNA polynucleotides having an open reading frame encoding a first antigenic polypeptide, formulated within a cationic lipid nanoparticle. Some aspects provide NAVs comprising one or more RNA polynucleotides having an open reading frame encoding a first antigenic polypeptide, formulated in a carrier having a molar ratio of about 20-60% cationic lipid:5-25% non-cationic lipid:25-55% sterol; and 0.5-15% PEG-modified lipid.

In some embodiments, the cationic lipid nanoparticle comprises a cationic lipid, a PEG-modified lipid, a sterol and a non-cationic lipid. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some embodiments, the cationic lipid nanoparticle has a molar ratio of about 20-60% cationic lipid:about 5-25% non-cationic lipid: about 25-55% sterol; and about 0.5-15% PEG-modified lipid. In some embodiments, the cationic lipid nanoparticle comprises a molar ratio of about 50% cationic lipid, about 1.5% PEG-modified lipid, about 38.5% cholesterol and about 10% non-cationic lipid. In some embodiments, the cationic lipid nanoparticle comprises a molar ratio of about 55% cationic lipid, about 2.5% PEG lipid, about 32.5% cholesterol and about 10% non-cationic lipid. In some embodiments, the cationic lipid is an ionizable cationic lipid and the non-cationic lipid is a neutral lipid, and the sterol is a cholesterol. In some embodiments, the cationic lipid nanoparticle has a molar ratio of 50:38.5:10:1.5 of cationic lipid:cholesterol:PEG2000-DMG:DSPC.

In some embodiments, the cationic lipid nanoparticle has a mean diameter of 50-150 nm. In some embodiments, the cationic lipid nanoparticle has a mean diameter of 80-100 nm. In some embodiments, the vaccine includes 1.5 mg/mL of RNA polynucleotide and 35-45 mg/mL lipids. In some embodiments, the NAV includes about 2 mg/mL of RNA polynucleotide and about 40 mg/mL lipids.

In some embodiments, the open reading frame is codon-optimized. In some embodiments, the first antigenic polypeptide is derived from an infectious agent. In some embodiments, the infectious agent is selected from a member of the group consisting of strains of viruses and strains of bacteria. In some embodiments, the one or more RNA polynucleotides encode a further antigenic polypeptide. In some embodiments, the further RNA polynucleotide comprises at least one chemical modification and a codon-optimized open reading frame, said open reading frame encoding an antigenic polypeptide.

In some embodiments, the one or more antigenic polypeptide is selected from those proteins listed in Tables 6-16, Tables 29-30, or fragments thereof. In some embodiments, the open reading frame of the one or more RNA polynucleotides and/or the open reading frame of the second RNA polynucleotide each, independently, encodes an antigenic polypeptide selected from Tables 6-16, Tables 29-30, or fragments thereof. In some embodiments, each of the open reading frame of the one or more RNA polynucleotides is selected from any of the RNA sequences Table 28, or fragments thereof.

In any of the embodiments provided herein, the infectious agent is a strain of virus selected from the group consisting of adenovirus; Herpes simplex, type 1; Herpes simplex, type 2; encephalitis virus, papillomavirus, Varicella-zoster virus; Epstein-barr virus; Human cytomegalovirus; Human herpes virus, type 8; Human papillomavirus; BK virus; JC virus; Smallpox; polio virus; Hepatitis B virus; Human bocavirus; Parvovirus B19; Human astrovirus; Norwalk virus; coxsackievirus; hepatitis A virus; poliovirus; rhinovirus; Severe acute respiratory syndrome virus; Hepatitis C virus; Yellow Fever virus; Dengue virus; West Nile virus; Rubella virus; Hepatitis E virus; Human Immunodeficiency virus (HIV); Influenza virus; Guanarito virus; Junin virus; Lassa virus; Machupo virus; Sabiá virus; Crimean-Congo hemorrhagic fever virus; Ebola virus; Marburg virus; Measles virus; Mumps virus; Parainfluenza virus; Respiratory syncytial virus; Human metapneumovirus; Hendra virus; Nipah virus; Rabies virus; Hepatitis D; Rotavirus; Orbivirus; Coltivirus; Banna virus; Human Enterovirus; Hanta virus; West Nile virus; Middle East Respiratory Syndrome Corona Virus; Japanese encephalitis virus; Vesicular exanthernavirus; and Eastern equine encephalitis.

In some embodiments, the virus is a strain of Influenza A or Influenza B or combinations thereof. In some embodiments, the strain of Influenza A or Influenza B is associated with birds, pigs, horses, dogs, humans or non-human primates. In some embodiments, the antigenic polypeptide encodes a hemagglutinin protein or fragment thereof. In some embodiments, the hemagglutinin protein is H1, H2, H3, H4, H5, H6, H7, H8, H9, H10, H11, H12, H13, H14, H15, H16, H17, H18, or a fragment thereof. In some embodiments, the hemagglutinin protein does not comprise a head domain (HA1). In some embodiments, the hemagglutinin protein comprises a portion of the head domain (HA1). In some embodiments, the hemagglutinin protein does not comprise a cytoplasmic domain. In some embodiments, the hemagglutinin protein comprises a portion of the cytoplasmic domain. In some embodiments, the truncated hemagglutinin protein. In some embodiments, the truncated hemagglutinin protein comprises a portion of the transmembrane domain. In some embodiments, the amino acid sequence of the hemagglutinin protein or fragment thereof comprises at least 90%, 91%, 92%, 93%, 94%, 95%, 96%, 97% 98%, or 99% identify with any of the amino acid sequences provided in Table 6-14. In some embodiments, the virus is selected from the group consisting of H1N1, H3N2, H7N9, and H10N8. In some embodiments, the antigenic polypeptide is selected from those proteins listed in Tables 6-14, or fragments thereof.

In some embodiments, the infectious agent is a strain of bacteria selected from Tuberculosis (*Mycobacterium tuberculosis*), clindamycin-resistant *Clostridium difficile*, fluoroquinolon-resistant *Clostridium difficile*, methicillin-resistant *Staphylococcus aureus* (MRSA), multidrug-resistant *Enterococcus faecalis*, multidrug-resistant *Enterococcus faecium*, multidrug-resistance *Pseudomonas aeruginosa*, multidrug-resistant *Acinetobacter baumannii*, and vancomycin-resistant *Staphylococcus aureus* (VRSA). In some embodiments, the bacteria is *Clostridium difficile*.

In some embodiments, the NAV is multivalent. In some embodiments, the open reading frame of the one or more RNA polynucleotides encode at least 2, 3, 4, 5, 6, 7, 8, 9 or 10 antigenic polypeptides. In some embodiments, the open reading frame of the one or more RNA polynucleotides encode at least 10, 15, 20 or 50 antigenic polypeptides. In some embodiments, the open reading frame of the one or more RNA polynucleotides encode 2-10, 10-15, 15-20, 20-50, 50-100 or 100-200 antigenic polypeptides.

In some embodiments, the RNA polynucleotide includes a chemical modification and the chemical modification is selected from any of those listed in Tables 22 and 23. In some embodiments, the chemical modification is selected from the group consisting of pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, Dihydropseudouridine, 5-methoxyuridine and 2'-O-methyl uridine. In some embodiments, the RNA polynucleotide includes a second chemical modification wherein said second chemical modification is selected from any of those listed in Tables 22 and 23. In some embodiments, the combination of first and second chemical modification is selected from those listed in Table 25.

Other aspects provide a NAV comprising one or more RNA polynucleotides having an open reading frame encoding a first antigenic polypeptide, formulated within a nanoparticle, wherein the nanoparticle has a mean diameter of 50-200 nm. In some embodiments, the nanoparticle has a polydiversity value of less than 0.4. In some embodiments, the nanoparticle has a net neutral charge at a neutral pH. In some embodiments, the nanoparticle has a mean diameter of 80-100 nm. In some embodiments, the nanoparticle is a cationic lipid nanoparticle comprises a cationic lipid, a PEG-modified lipid, a sterol and a non-cationic lipid. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy) heptadecanedioate (L319).

Other aspects provide NAVs comprising one or more RNA polynucleotides having an open reading frame encoding a first antigenic polypeptide, wherein at least 80% of the uracil in the open reading frame have a chemical modification. In some embodiments, 100% of the uracil in the open reading frame have a chemical modification. In some embodiments, the chemical modification is in the 5-position of the uracil. In some embodiments, the chemical modification is a N1-methyl pseudouridine. In some embodiments, the nucleic acid vaccine is formulated within a cationic lipid complex or cationic lipid nanoparticle.

Yet other aspects provide NAVs comprising one or more RNA polynucleotides having an open reading frame encoding a first antigenic polypeptide, at least one 5' terminal cap and at least one chemical modification, formulated within a cationic lipid nanoparticle. In some embodiments, the 5' terminal cap is 7mG(5')ppp(5')NlmpNp. In some embodiments, the chemical modification is selected from any of those listed in Tables 22 and 23. In some embodiments, the chemical modification is selected from the group consisting of pseudouridine, N1-methylpseudouridine, 2-thiouridine, 4'-thiouridine, 5-methylcytosine 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, Dihydropseudouridine, 5-methoxyuridine and 2'-O-methyl uridine. In some embodiments, the RNA polynucleotide further comprises a second chemical modification wherein said second chemical modification is selected from any of those listed in Tables 22 and 23. In some embodiments, the combination of first and second chemical modification is selected from those listed in Table 25.

In some embodiments, the cationic lipid nanoparticle comprises a cationic lipid, a PEG-modified lipid, a sterol and a non-cationic lipid. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some embodiments, the cationic lipid nanoparticle has a molar ratio of about 20-60% cationic lipid:about 5-25% non-cationic lipid: about 25-55% sterol; and about 0.5-15% PEG-modified lipid.

Some aspects provide NAVs comprising one or more RNA polynucleotides having an open reading frame encoding a hemagglutinin protein and a pharmaceutically acceptable carrier or excipient, formulated within a cationic lipid nanoparticle. In some embodiments, the hemagglutinin protein is selected from HAL HA7 and HA10. In some embodiments, the RNA polynucleotide does not encode F protein. In some embodiments, the RNA polynucleotide further encodes neuraminidase protein. In some embodiments, the hemagglutinin protein is derived from a strain of Influenza A virus or Influenza B virus or combinations thereof. In some embodiments, the Influenza virus is selected from H1N1, H3N2, H7N9, and H10N8.

In some embodiments, the RNA polynucleotide includes a chemical modification and the chemical modification is selected from any of those listed in Tables 22 and 23. In some embodiments, the chemical modification is selected from the group consisting of pseudouridine, N1-methylpseudouridine, 2-thiouridine, 4'-thiouridine, 5-methylcytosine-2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, Dihydropseudouridine, 5-methoxyuridine and 2'-O-methyl uridine. In some embodiments, the RNA polynucleotide further comprises a second chemical modification wherein said second chemical modification is selected from any of those listed in Tables 22 and 23. In some embodiments, the combination of first and second chemical modification is selected from those listed in Table 25.

In some embodiments, the cationic lipid nanoparticle comprises a cationic lipid, a PEG-modified lipid, a sterol and a non-cationic lipid. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some embodiments, the cationic lipid nanoparticle has a molar ratio of about 20-60% cationic lipid:about 5-25% non-cationic lipid: about 25-55% sterol; and about 0.5-15% PEG-modified lipid.

In some embodiments, the RNA polynucleotide comprises SEQ ID NOs 197-392. In some embodiments, the RNA polynucleotide comprises a polynucleotide having at least 80% sequence identity to SEQ ID NOs 197-392. In some embodiments, the RNA polynucleotide comprises a polynucleotide encoding an amino acid sequence having at least 90% sequence identity to SEQ ID NO 941. In some embodiments, the RNA polynucleotide comprises a polynucleotide encoding the amino acid sequence of SEQ ID NO941. In some embodiments, the RNA polynucleotide comprises a polynucleotide encoding an amino acid sequence having at least 90% sequence identity to SEQ ID NO 946. In some embodiments, the RNA polynucleotide comprises a polynucleotide encoding the amino acid sequence of SEQ ID NO 946. In some embodiments, the RNA polynucleotide comprises a polynucleotide encoding an amino acid sequence having at least 90% sequence identity to SEQ ID NO 1022. In some embodiments, the RNA polynucleotide comprises a polynucleotide encoding the amino acid sequence of SEQ ID NO 1022. In some embodiments, the RNA polynucleotide comprises a polynucleotide encoding an amino acid sequence having at least 90% sequence identity to SEQ ID NO 1023. In some embodiments, the RNA polynucleotide comprises a polynucleotide encoding the amino acid sequence of SEQ ID NO 1023. In some embodiments, the RNA polynucleotide comprises SEQ ID NO 1024. In some embodiments, the RNA polynucleotide comprises a polynucleotide having 80-98% sequence identity to SEQ ID NO 1024. In some embodiments, the RNA polynucleotide comprises SEQ ID NO 1025. In some embodiments, the RNA polynucleotide comprises a polynucleotide having 80-98% sequence identity to SEQ ID NO 1025. In some embodiments, the RNA polynucleotide comprises SEQ ID NO 1026. In some embodiments, the RNA polynucleotide comprises a polynucleotide having 80-98% sequence identity to SEQ ID NO 1026. In some embodiments, the RNA polynucleotide comprises SEQ ID NO 1027. In some embodiments, the RNA polynucleotide comprises a polynucleotide having 80-98% sequence identity to SEQ ID NO 1027.

Aspects of the invention provide nucleic acids comprising 80-95% sequence identity to SEQ ID NO 1027 or SEQ ID NO 1026. Other aspects provide a nucleic acid comprising SEQ ID NO: 395.

Yet other aspects provide a method of inducing an antigen specific immune response in a subject comprising administering any of the vaccines described herein to the subject in an effective amount to produce an antigen specific immune response. In some embodiments, the antigen specific immune response comprises a T cell response. In some embodiments, the antigen specific immune response comprises a B cell response. In some embodiments, the method of producing an antigen specific immune response involves a single administration of the vaccine. In some embodiments, the method further comprises administering a booster dose of the vaccine. In some embodiments, the vaccine is administered to the subject by intradermal or intramuscular injection.

In some embodiments, the booster dose of the vaccine is administered to the subject on day twenty one. In some embodiments, a dosage of between 10 ug/kg and 400 ug/kg of the vaccine is administered to the subject. In some embodiments, a dosage of 25 micrograms of the RNA polynucleotide is included in the vaccine administered to the subject. In some embodiments, a dosage of 100 micrograms of the RNA polynucleotide is included in the vaccine administered to the subject. In some embodiments, a dosage of 400 micrograms of the RNA polynucleotide is included in the vaccine administered to the subject. In some embodiments, the RNA polynucleotide accumulates at a 100 fold higher level in the local lymph node in comparison with the distal lymph node.

Aspects provide methods of preventing or treating influenza viral infection comprising administering to a subject any of the vaccines described herein. In some embodiments, the antigen specific immune response comprises a T cell response. In some embodiments, the antigen specific immune response comprises a B cell response. In some embodiments, the method of producing an antigen specific immune response involves a single administration of the vaccine. In some embodiments, the vaccine is administered to the subject by intradermal or intramuscular injection.

Yet other aspects provide methods of vaccinating a subject comprising administering to the subject a nucleic acid vaccine comprising one or more RNA polynucleotides having an open reading frame encoding a first antigenic polypeptide, wherein the RNA polynucleotide does not include a stabilization element, and wherein an adjuvant is not coformulated or co-administered with the vaccine. In some embodiments, a dosage of between 10 ug/kg and 400 ug/kg of the nucleic acid vaccine is administered to the subject. In some embodiments, the nucleic acid vaccine is administered to the subject by intradermal or intramuscular injection. In some embodiments, the nucleic acid vaccine is administered to the subject on day zero. In some embodiments, a second dose of the nucleic acid vaccine is administered to the subject on day twenty one.

In some embodiments, a dosage of 25 micrograms of the RNA polynucleotide is included in the nucleic acid vaccine administered to the subject. In some embodiments, a dosage of 100 micrograms of the RNA polynucleotide is included in the nucleic acid vaccine administered to the subject. In some embodiments, a dosage of 400 micrograms of the RNA polynucleotide is included in the nucleic acid vaccine administered to the subject. In some embodiments, the RNA polynucleotide accumulates at a 100 fold higher level in the local lymph node in comparison with the distal lymph node.

Aspects of the invention provide a nucleic acid vaccine comprising one or more RNA polynucleotides having an open reading frame encoding a first antigenic polypeptide, wherein the RNA polynucleotide does not include a stabilization element, and a pharmaceutically acceptable carrier or excipient, wherein an adjuvant is not included in the vaccine. In some embodiments, the stabilization element is a histone stem-loop. In some embodiments, the stabilization element is a nucleic acid sequence having decreased GC content relative to wild type sequence.

Aspects of the invention provide NAVs comprising one or more RNA polynucleotides having an open reading frame encoding a first antigenic polypeptide, wherein the RNA polynucleotide is present in the formulation for in vivo administration to a host, which confers an antibody titer superior to the criterion for seroprotection for the first antigen for an acceptable percentage of human subjects. In some embodiments, the antibody titer is a neutralizing antibody titer.

Also provided are NAVs comprising one or more RNA polynucleotides having an open reading frame encoding a first antigenic polypeptide, wherein the RNA polynucleotide is present in a formulation for in vivo administration to a host for eliciting a longer lasting high antibody titer than an antibody titer elicited by an mRNA vaccine having a stabilizing element or formulated with an adjuvant and encoding the first antigenic polypeptide. In some embodiments, the RNA polynucleotide is formulated to produce a neutralizing antibodies within one week of a single administration. In some embodiments, the adjuvant is selected from a cationic peptide and an immunostimulatory nucleic acid. In some embodiments, the cationic peptide is protamine.

Aspects provide NAVs comprising one or more RNA polynucleotides having an open reading frame comprising at least one chemical modification, the open reading frame encoding a first antigenic polypeptide, wherein the RNA polynucleotide is present in the formulation for in vivo administration to a host such that the level of antigen expression in the host significantly exceeds a level of antigen expression produced by an mRNA vaccine having a stabilizing element or formulated with an adjuvant and encoding the first antigenic polypeptide.

Other aspects provide NAVs comprising one or more RNA polynucleotides having an open reading frame comprising at least one chemical modification, the open reading frame encoding a first antigenic polypeptide, wherein the vaccine has at least 10 fold less RNA polynucleotide than is required for an unmodified mRNA vaccine to produce an equivalent antibody titer. In some embodiments, the RNA polynucleotide is present in a dosage of 25-100 micrograms.

Aspects of the invention also provide a unit of use vaccine, comprising between 10 ug and 400 ug of one or more RNA polynucleotides having an open reading frame comprising at least one chemical modification, the open reading frame encoding a first antigenic polypeptide, and a pharmaceutically acceptable carrier or excipient, formulated for delivery to a human subject. In some embodiments, the vaccine further comprises a cationic lipid nanoparticle.

Aspects of the invention provide methods of creating, maintaining or restoring antigenic memory to an influenza strain in an individual or population of individuals comprising administering to said individual or population an antigenic memory booster nucleic acid vaccine comprising (a) at least one RNA polynucleotide, said polynucleotide comprising at least one chemical modification and two or more codon-optimized open reading frames, said open reading frames encoding a set of reference antigenic polypeptides, and (b) optionally a pharmaceutically acceptable carrier or excipient. In some embodiments, the vaccine is administered to the individual via a route selected from the group consisting of intramuscular administration, intradermal administration and subcutaneous administration. In some embodiments, the administering step comprises contacting a muscle tissue of the subject with a device suitable for injection of the composition. In some embodiments, the administering step comprises contacting a muscle tissue of the subject with a device suitable for injection of the composition in combination with electroporation.

Aspects of the invention provide methods of vaccinating a subject comprising administering to the subject a single dosage of between 25 ug/kg and 400 ug/kg of a nucleic acid vaccine comprising one or more RNA polynucleotides having an open reading frame encoding a first antigenic polypeptide in an effective amount to vaccinate the subject.

Aspects provide NAVs comprising one or more RNA polynucleotides having an open reading frame encoding a hemagglutinin protein fragment, wherein the hemagglutinin protein includes only a portion of at least one of: a head domain (HA1), a cytoplasmic domain, or a transmembrane domain. In some embodiments, the hemagglutinin protein is H1, H2, H3, H4, H5, H6, H7, H8, H9, H10, H11, H12, H13, H14, H15, H16, H17, H18. In some embodiments, the hemagglutinin protein does not comprise the head domain (HA1). In some embodiments, the hemagglutinin protein does not comprise the cytoplasmic domain. In some embodiments, the truncated hemagglutinin protein does not comprise the transmembrane domain. In some embodiments, the amino acid sequence of the hemagglutinin protein comprises at least 90%, 91%, 92%, 93%, 94%, 95%, 96%, 97% 98%, or 99% identify with any of the amino acid sequences provided in Tables 6-16.

In some embodiments, the vaccine is formulated within a cationic lipid complex or cationic lipid nanoparticle. In some embodiments, the polynucleotide comprises at least one 5' terminal cap and at least one chemical modification.

Aspects also provide any of the vaccines described herein for use in a method of inducing an antigen specific immune response in a subject. In some embodiments, the method comprises administering the vaccine to the subject in an effective amount to produce an antigen specific immune response.

Other aspects provide a use of any of the vaccines described herein in the manufacture of a medicament for use in a method of inducing an antigen specific immune response in a subject, the method comprising administering the vaccine to the subject in an effective amount to produce an antigen specific immune response.

Aspects also provide for any of the vaccines described herein for use in a method of preventing or treating influenza viral infection, the method comprising administering the vaccine to a subject.

Other aspects provide a use any of the vaccines described herein in the manufacture of a medicament for use in a method of preventing or treating influenza viral infection, the method comprising administering the vaccine to a subject.

Other aspects provide nucleic acid vaccines for use in a method of vaccinating a subject wherein the nucleic acid vaccine comprises a first RNA polynucleotide having an open reading frame encoding a first antigenic polypeptide, wherein the RNA polynucleotide does not include a stabilization element, and wherein an adjuvant is not coformulated or co-administered with the vaccine. In some embodiments, the method further comprises administering the vaccine to the subject.

Other aspects provide a use of a nucleic acid vaccine in the manufacture of a medicament for use in a method of vaccinating a subject wherein the nucleic acid vaccine comprises a first RNA polynucleotide having an open reading frame encoding a first antigenic polypeptide, wherein the RNA polynucleotide does not include a stabilization element, and wherein an adjuvant is not coformulated or co-administered with the vaccine. In some embodiments, the method further comprises administering the vaccine to the subject.

Aspects of the invention provide an antigenic memory booster nucleic acid vaccine for use in a method of creating, maintaining or restoring antigenic memory to an influenza strain in an individual or population of individuals. In some embodiments, the antigenic memory booster nucleic acid vaccine comprises (a) at least one RNA polynucleotide, said polynucleotide comprising at least one chemical modification and two or more codon-optimized open reading frames, said open reading frames encoding a set of reference antigenic polypeptides, and (b) optionally a pharmaceutically acceptable carrier or excipient; and wherein the method comprises administering to said individual or population the antigenic memory booster nucleic acid vaccine.

Other aspects provide a use of an antigenic memory booster nucleic acid vaccine in the manufacture of a medicament for use in a method of creating, maintaining or restoring antigenic memory to an influenza strain in an individual or population of individuals, wherein the antigenic memory booster nucleic acid vaccine comprises (a) at least one RNA polynucleotide, said polynucleotide comprising at least one chemical modification and two or more codon-optimized open reading frames, said open reading frames encoding a set of reference antigenic polypeptides, and (b) optionally a pharmaceutically acceptable carrier or excipient; and wherein the method comprises administering to said individual or population the antigenic memory booster nucleic acid vaccine.

Other aspects provide a nucleic acid vaccine for use in a method of vaccinating a subject, wherein the nucleic acid vaccine comprises a first RNA polynucleotide having an open reading frame encoding a first antigenic polypeptide, and wherein the method comprises administering to the subject a single dosage of between 25 ug/kg and 400 ug/kg of the nucleic acid vaccine in an effective amount to vaccinate the subject.

Other aspects provide a use of a nucleic acid vaccine in the manufacture of a medicament for use in a method of vaccinating a subject, wherein the nucleic acid vaccine comprises a first RNA polynucleotide having an open reading frame encoding a first antigenic polypeptide, and wherein the method comprises administering to the subject a single dosage of between 25 ug/kg and 400 ug/kg of the nucleic acid vaccine in an effective amount to vaccinate the subject.

In some embodiments, the NAV polynucleotides may encode one or more polypeptides of an influenza strain as an antigen. Such antigens include, but are not limited to those antigens encoded by the polynucleotides listed in the Tables presented herein. In the table, the GenBank Accession Number or GI Accession Number represents either the complete or partial CDS of the encoded antigen. The NAV polynucleotides may comprise a region of any of the sequences listed in the tables or entire coding region of the mRNA listed. They may comprise hybrid or chimeric regions, or mimics or variants.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIG. 1A is a schematic of a polynucleotide construct taught in commonly owned co-pending U.S. patent application Ser. No. 13/791,922 filed Mar. 9, 2013, the contents of which are incorporated herein by reference. FIG. 1B is a schematic of a linear polynucleotide construct.

FIG. 4 is a schematic of a series of chimeric polynucleotides illustrating various patterns of positional modifications based on Formula I.

FIG. 5 is a a is a schematic of a series of chimeric polynucleotides illustrating various patterns of positional modifications based on Formula I and further illustrating a blocked or structured 3' terminus.

FIG. 8A shows a circular construct comprising at least one sensor region and a spacer region. FIG. 8B shows a non-coding circular construct.

FIG. 12A shows percent survival at 1 week post challenge.
FIG. 12B shows percent survival at 2 weeks post challenge.
FIG. 12C shows percent survival at 3 weeks post challenge.
FIG. 12D shows percent survival at 4 weeks post challenge.

FIG. 14A shows IFNγ production upon H1 protein/peptide stimulation. FIG. 14B shows IFNγ production upon H7 protein/peptide stimulation. FIG. 14C shows IFNγ production upon PMA+ionomycin stimulation.

FIG. 21A shows survival at day 7 post challenge. FIG. 21B shows survival at day 21 post challenge. FIG. 21C shows survival at day 84 post challenge. FIG. 21D shows HA1 titers.

FIGS. 22-1 through 22-51 shows an alignment of amino acid sequences of hemagglutinin proteins from influenza A H7N9 strains relative to a consensus sequence. The sequences, from top to bottom, correspond to SEQ ID NOs: 1020, 8, 13, 7, 98, 99, 100, 96, 89, 92, 24, 29, 90, 57, 42, 27, 78, 74, 95, 30, 31, 32, 25, 39, 38, 35, 36, 37, 82, 91, 83, 104, 93, 94, 178, 133, 134, 132, 135, 136, 173, 175, 174, 73, 70, 33, 34, 41, 40, 76, 75, 72, 79, 80, 86, 105, 77, 11, 12, 4, 164, 150, 151, 171, 152, 165, 121, 166, 167, 156, 157, 168, 143, 169, 144, 145, 122, 113, 117, 119, 138, 137, 146, 147, 148, 158, 159, 160, 161, 162, 62, 129, 130, 141, 123, 124, 176, 125, 182, 183, 179, 180, 184, 181, 185, 186, 187, 188, 189, 190, 193, 177, 140, 49, 47, 48, 97, 50, 51, 191, 195, 196, 128, 131, 170, 111, 112, 118, 108, 120, 109, 107, 26, 106, 52, 53, 28, 192, 45, 46, 6, 44, 43, 126, 19, 21, 20, 59, 54, 71, 102, 10, 101, 2, 58, 23, 55, 5, 22, 103, 153, 154, 155, 172, 142, 114, 115, 116, 127, 149, 163, 139, 194, 110, 17, 81, 3, 85, 87, 88, 84, 61, 60, 1, 9, 14, 15, 16, 64, 63, 66, 65, 67, 68, 69, 18, and 56.

FIGS. 23-1 through 23-14 (SEQ ID NOS: 1021, 967-1019) shows an alignment of amino acid sequences of hemagglutinin proteins from influenza A H10N8 strains relative to a consensus sequence.

DETAILED DESCRIPTION

Figure 1A:
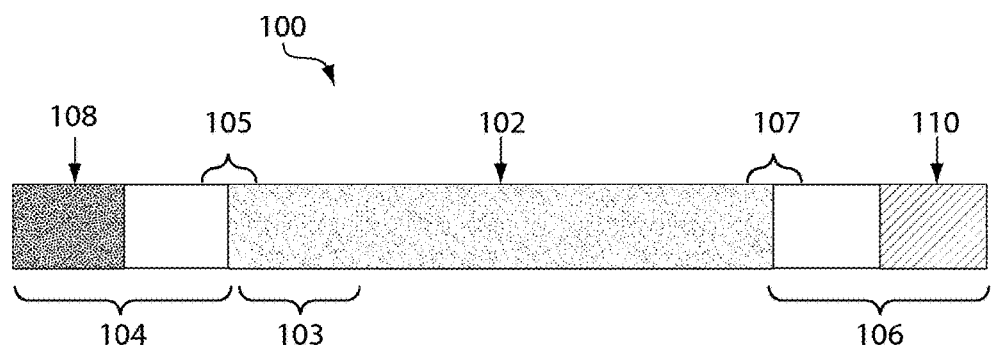
FIGS. 1A and 1B are schematics of a polynucleotide construct.

It is of great interest in the fields of therapeutics, diagnostics, reagents and for biological assays to be able design, synthesize and deliver a nucleic acid, e.g., a ribonucleic acid (RNA) for example, a messenger RNA (mRNA) encoding a peptide or polypeptide of interest inside a cell, whether in vitro, in vivo, in situ or ex vivo, such as to effect physiologic outcomes which are beneficial to the cell, tissue or organ and ultimately to an organism. One beneficial outcome is to cause intracellular translation of the nucleic acid and production of at least one encoded peptide or polypeptide of interest.

Of particular interest, is the ability to design, synthesize and deliver a nucleic acid, e.g., a ribonucleic acid (RNA), for example, a messenger RNA (mRNA), which encodes an antigen, e.g., an antigen derived from an infectious microorganism, for the purpose of vaccination.

Described herein are compositions (including pharmaceutical compositions) and methods for the selection, design, preparation, manufacture, formulation, and/or use of nucleic acid vaccines (NAVs) where at least one component of the NAV is a nucleic acid molecule, e.g., a polynucleotide. In particular, described herein are compositions (including pharmaceutical compositions) and methods for the selection, design, preparation, manufacture, formulation, and/or use of nucleic acid vaccines (NAVs) where at least one component of the NAV is a polynucleotide. In particular, described herein are compositions (including pharmaceutical compositions) and methods for the selection, design, preparation, manufacture, formulation, and/or use of nucleic acid vaccines (NAVs) where at least one component of the NAV is a RNA polynucleotide, e.g., an mRNA polynucleotide which encodes an antigen, e.g., an antigen derived from an infectious microorganism. In certain embodiments, the invention relates to compositions (including pharmaceutical compositions) and methods for the selection, design, preparation, manufacture, formulation, and/or use of ribonucleic acid vaccines (RNAVs) where at least one component of the RNAV is a ribonucleic acid molecule, e.g., a mRNA which encodes an antigen, e.g., an antigen derived from an infectious microorganism. As such the present invention is directed, in part, to polynucleotides, specifically in vitro transcription (IVT) polynucleotides, chimeric polynucleotides and/or circular polynucleotides which may function as a vaccine or component of a vaccine.

Also provided are systems, processes, devices and kits for the selection, design and/or utilization of the NAVs described herein.

According to the present invention, the polynucleotides may be modified in a manner as to avoid the deficiencies of or provide improvements over other polynucleotide molecules of the art.

Although attempts have been made to produce functional RNA vaccines, including mRNA vaccines and self-replicating RNA vaccines, the therapeutic efficacy of these RNA vaccines have not yet been fully established. Quite surprisingly, the inventors have discovered a class of formulations for delivering mRNA vaccines in vivo that results in significantly enhanced, and in many respects synergistic, immune responses including enhanced antigen generation and functional antibody production with neutralization capability. These results are achieved even when significantly lower doses of the mRNA are administered in comparison with mRNA doses used in other classes of lipid based formulations. The formulations of the invention have demonstrated significant unexpected in vivo immune responses sufficient to establish the efficacy of functional mRNA vaccines as prophylactic and therapeutic agents.

The invention involves, in some aspects, the surprising finding that lipid nanoparticle (LNP) formulations significantly enhance the effectiveness of mRNA vaccines, including chemically modified and unmodified mRNA vaccines. The efficacy of mRNA vaccines formulated in LNP was examined in vivo using several distinct viral antigens and in a variety of different animal models. The results presented herein demonstrate the unexpected superior efficacy of the mRNA vaccines formulated in LNP over other mRNA vaccines formulated in other lipid based carriers as well as over protein antigens.

In addition to providing an enhanced immune response, the formulations of the invention generate a more rapid immune response following a single dose of antigen than other mRNA or protein based vaccines tested. A study described herein involved intravenous (IV), intramuscular (IM), or intradermal (ID) vaccination of mice, followed by challenge with a lethal dose of virus. In addition to all of the vaccinated animals surviving the lethal dose, significantly stronger early immune responses were observed (anti-viral activity via virus neutralization assay and HA inhibition (HA1)) in comparison to protein antigen and other lipid based formulations (lipoplex). The data demonstrates that as early as 1 week after vaccination two groups of animals receiving a mRNA-LNP formulation (ID or IM) displayed HA1 titers over 40, at 60 and 114, respectively. An HA1 titer of greater than 40 is deemed sufficient to protect from a lethal challenge of influenza. The rapid response was unexpected, particularly when compared to the response seen with protein antigen and mRNA vaccines formulated in other lipid carriers (lipoplex), which at one week and even at three weeks following vaccination continued to show ineffective HA1 titers of less than 40.

At each of the later time points (3 weeks and 5 weeks), the formulations of the invention continued to provide significantly stronger therapeutic responses than did protein antigen. In fact both chemically unmodified and modified mRNA-LNP formulation administered by IV route had enhanced HA1 titers with respect to the protein antigen. By week 3, all of the animals receiving an mRNA-LNP formulation by IM or ID administration displayed HA1 activity over 40, as compared to protein antigen, which at one week and three weeks continued to show HA1 titers of less than 40. By week 5 a mRNA-LNP formulation administered by ID route had a surprising HA1 activity of greater than 10,000, in contrast to the HA1 titer of around 400 for protein antigen at that time point. Mice receiving a mRNA-LNP formulation also displayed neutralizing activity of 79-250 (IM) and 250 (ID) by microneutralization assay, in comparison to protein antigen, which had undetectable neutralization activity at that time point. By week 5 following vaccination, five of the six LNP formulated groups showed high neutralizing activity between 789 and 24892. In contrast, the mice vaccinated with protein antigen displayed neutralizing activity in only 3 of 5 mice and ranging only between 79 and 250.

The mRNA-LNP formulations of the invention also produced quantitatively and qualitatively better immune responses than did mRNA vaccines formulated in a different lipid carrier (lipoplex). At week 5 the mRNA-lipoplex vaccine produced HA1 titers of 197, in comparison to those achieved by the mRNA-LNP formulations of the invention (HA1 titers of 635-10,152). At all other time points and for all of the mRNA-lipoplex vaccines, none of the HA1 titers reached the critical level of greater than 40. Additionally, the mRNA-lipoplex vaccines did not result in any detectable neutralizing activity in the microneutralization activity, even as late as five weeks after vaccination.

The data described herein demonstrate that the formulations of the invention produced significant unexpected improvements over both existing protein antigen vaccines and mRNA vaccine formulations, including: 100% rescue from lethal influenza challenge with rapid onset of protective antibody titers after 1 week and high antibody titers, i.e., 50 fold over unmodified mRNA and 20 fold over the protein vaccine.

Additionally, the mRNA-LNP formulations of the invention were superior to other lipid formulations even when the dose of mRNA was significantly lower than in the other lipid formulations. For instance, the data described above was generated using 10 µg of mRNA in the mRNA-LNP formulations in contrast to 80 µg of mRNA in the mRNA-lipoplex formulation.

The formulations of the invention also showed strong efficacy in several non-rodent animal models, including non-human primates. Highly effective vaccination was observed in cynomoglus monkeys and ferrets. Cynomoglus monkeys were vaccinated with various doses of mRNA-LNP formulations (50 µg/dose, 200 µg/dose, 400 µg/dose). Quite surprisingly, the vaccine formulations of the invention at all doses measured significantly reduced viral titers in the lungs of ferrets when exposed to virus just 7 days following single vaccination. Statistically significant increases in antibody titer as measured by HA1 and microneutralization were detected as early as 7 days following vaccination and through the entire length of the study (84 days). A single vaccination was able to eliminate all virus in most animals.

The LNP used in the studies described herein has been used previously to deliver siRNA various in animal models as well as in humans. In view of the observations made in association with the siRNA delivery of LNP formulations, the fact that LNP is useful in vaccines is quite surprising. It has been observed that therapeutic delivery of siRNA formulated in LNP causes an undesirable inflammatory response associated with a transient IgM response, typically leading to a reduction in antigen production and a compromised immune response. In contrast to the findings observed with siRNA, the LNP-mRNA formulations of the invention are demonstrated herein to generate enhanced IgG levels, sufficient for prophylactic and therapeutic methods rather than transient IgM responses.

I. Nucleic Acid Vaccines (NAVs)

Nucleic Acid Vaccines (NAVs) of the present invention comprise one or more polynucleotides, e.g., polynucleotide constructs, which encode one or more wild type or engineered antigens. Exemplary polynucleotides, e.g., polynucleotide constructs, include antigen-encoding RNA polynucleotides, e.g., mRNAs. In exemplary aspect, polynucleotides of the invention, e.g., antigen-encoding RNA polynucleotides, may include at least one chemical modification.

NAV compositions of the invention may comprise other components including, but not limited to, tolerizing agents or adjuvants.

Tolerizing Agent or Composition

Where auto-immunity mediated side effects occur, tolerizing mRNA and/or such as any of those taught for example in U.S. Ser. No. 61/892,556 filed Oct. 18, 2013, and PCT/US2014/61104 filed Oct. 17, 2014, the contents of which are incorporated herein by reference in their entirety) are co-administered with the NAV to induce antigen specific tolerance.

Adjuvants

Adjuvants or immune potentiators, may also be administered with or in combination with one or more NAVs.

In one embodiment, an adjuvant acts as a co-signal to prime T-cells and/or B-cells and/or NK cells as to the existence of an infection.

Advantages of adjuvants include the enhancement of the immunogenicity of antigens, modification of the nature of the immune response, the reduction of the antigen amount needed for a successful immunization, the reduction of the frequency of booster immunizations needed and an improved immune response in elderly and immunocompromised vaccinees. These may be co-administered by any route, e.g., intramusculary, subcutaneous, IV or intradermal injections.

Adjuvants useful in the present invention may include, but are not limited to, natural or synthetic. They may be organic or inorganic.

Adjuvants may be selected from any of the classes (1) mineral salts, e.g., aluminium hydroxide and aluminium or calcium phosphate gels; (2) emulsions including: oil emulsions and surfactant based formulations, e.g., microfluidised detergent stabilised oil-in-water emulsion, purified saponin, oil-in-water emulsion, stabilised water-in-oil emulsion; (3) particulate adjuvants, e.g., virosomes (unilamellar liposomal vehicles incorporating influenza haemagglutinin), structured complex of saponins and lipids, polylactide co-glycolide (PLG); (4) microbial derivatives; (5) endogenous human immunomodulators; and/or (6) inert vehicles, such as gold particles; (7) microorganism derived adjuvants; (8) tensoactive compounds; (9) carbohydrates; or combinations thereof.

Adjuvants for DNA nucleic acid vaccines (DNA) have been disclosed in, for example, Kobiyama, et al Vaccines, 2013, 1(3), 278-292, the contents of which are incorporated herein by reference in their entirety. Any of the adjuvants disclosed by Kobiyama may be used in the RNAVs of the present invention.

Other adjuvants which may be utilized in the RNAVs of the present invention include any of those listed on the web-based vaccine adjuvant database, Vaxjo; http://www.violinet.org/vaxjo/ and described in for example Sayers, et al., J. Biomedicine and Biotechnology, volume 2012 (2012), Article ID 831486, 13 pages, the content of which is incorporated herein by reference in its entirety.

Selection of appropriate adjuvants will be evident to one of ordinary skill in the art. Specific adjuvants may include, without limitation, cationic liposome-DNA complex JVRS-100, aluminum hydroxide vaccine adjuvant, aluminum phosphate vaccine adjuvant, aluminum potassium sulfate adjuvant, alhydrogel, ISCOM(s)™, Freund's Complete Adjuvant, Freund's Incomplete Adjuvant, CpG DNA Vaccine Adjuvant, Cholera toxin, Cholera toxin B subunit, Liposomes, Saponin Vaccine Adjuvant, DDA Adjuvant, Squalene-based Adjuvants, Etx B subunit Adjuvant, IL-12 Vaccine Adjuvant, LTK63 Vaccine Mutant Adjuvant, TiterMax Gold Adjuvant, Ribi Vaccine Adjuvant, Montanide ISA 720 Adjuvant, *Corynebacterium*-derived P40 Vaccine Adjuvant, MPL™ Adjuvant, AS04, AS02, Lipopolysaccharide Vaccine Adjuvant, Muramyl Dipeptide Adjuvant, CRL1005, Killed *Corynebacterium parvum* Vaccine Adjuvant, Montanide ISA 51, *Bordetella pertussis* component Vaccine Adjuvant, Cationic Liposomal Vaccine Adjuvant, Adamantylamide Dipeptide Vaccine Adjuvant, Arlacel A, VSA-3 Adjuvant, Aluminum vaccine adjuvant, Polygen Vaccine Adjuvant, Adjumer™, Algal Glucan, Bay R1005, Theramide®, Stearyl Tyrosine, Specol, Algammulin, Avridine®, Calcium Phosphate Gel, CTA1-DD gene fusion protein, DOC/Alum Complex, Gamma Inulin, Gerbu Adjuvant, GM-CSF, GMDP, Recombinant hIFN-gamma/Interferon-g, Interleukin-1β, Interleukin-2, Interleukin-7, Sclavo peptide, Rehydragel LV, Rehydragel HPA, Loxoribine, MF59, MTP-PE Liposomes, Murametide, Murapalmitine, D-Murapalmitine, NAGO, Non-Ionic Surfactant Vesicles, PMMA, Protein Cochleates, QS-21, SPT (Antigen Formulation), nanoemulsion vaccine adjuvant, AS03, Quil-A vaccine adjuvant, RC529 vaccine adjuvant, LTR192G Vaccine Adjuvant, E. coli heat-labile toxin, LT, amorphous aluminum hydroxyphosphate sulfate adjuvant, Calcium phosphate vaccine adjuvant, Montanide Incomplete Seppic Adjuvant, Imiquimod, Resiquimod, AF03, Flagellin, Poly(I:C), ISCOMATRIX®, Abisco-100 vaccine adjuvant, Albumin-heparin microparticles vaccine adjuvant, AS-2 vaccine adjuvant, B7-2 vaccine adjuvant, DHEA vaccine adjuvant, Immunoliposomes Containing Antibodies to Costimulatory Molecules, SAF-1, Sendai Proteoliposomes, Sendai-containing Lipid Matrices, Threonyl muramyl dipeptide (TMDP), Ty Particles vaccine adjuvant, Bupivacaine vaccine adjuvant, DL-PGL (Polyester poly (DL-lactide-co-glycolide)) vaccine adjuvant, IL-15 vaccine adjuvant, LTK72 vaccine adjuvant, MPL-SE vaccine adjuvant, non-toxic mutant E112K of Cholera Toxin mCT-E112K, and/or Matrix-S.

Other adjuvants which may be co-administered with the NAVs of the invention include, but are not limited to interferons, TNF-alpha, TNF-beta, chemokines such as CCL21, eotaxin, HMGB1, SA100-8alpha, GCSF, GMCSF, granulysin, lactoferrin, ovalbumin, CD-40L, CD28 agonists, PD-1, soluble PD1, L1 or L2, or interleukins such as IL-1, IL-2, IL-4, IL-6, IL-7, IL-10, IL-12, IL-13, IL-21, IL-23, IL-15, IL-17, and IL-18. These may be administered with the NAV on the same encoded polynucleotide, e.g., polycistronic, or as separate mRNA encoding the adjuvant and antigen.

Valency

NAVs of the present invention may vary in their valency. Valency refers to the number of antigenic components in the NAV or NAV polynucleotide (e.g., RNA polynucleotide) or polypeptide. In some embodiments, the NAVs are monovalent. In some embodiments, the NAVs are divalent. In some embodiments the NAVs are trivalent. In some embodiments the NAVs are multi-valent. Multivalent vaccines may comprise 2, 3, 4, 5, 6, 7, 8, 9, 10, 11, 12, 13, 14, 15, 16, 17, 18, 19, 20, or more antigens or antigenic moieties (e.g., antigenic peptides, etc.). The antigenic components of the NAVs may be on a single polynucleotide or on separate polynucleotides.

Therapeutics

The NAVs of the present invention can be used as therapeutic or prophylactic agents. They are provided for use in medicine and/or for the priming of immune effector cells, e.g., stimulate/transfect PBMCs ex vivo and re-infuse the activated cells. For example, a NAV described herein can be administered to a subject, wherein the polynucleotides is translated in vivo to produce an antigen. Provided are compositions, methods, kits, and reagents for diagnosis, treatment or prevention of a disease or condition in humans and other mammals. The active therapeutic agents of the invention include NAVs, cells containing NAVs or polypeptides translated from the polynucleotides contained in said NAVs.

Provided herein are methods of inducing translation of a polypeptide (e.g., antigen or immunogen) in a cell, tissue or organism using the polynucleotides of the NAVs described herein. Such translation can be in vivo, ex vivo, in culture, or in vitro. The cell, tissue or organism is contacted with an effective amount of a composition containing a NAV which contains a polynucleotide that has at least one a translatable region encoding the polypeptide of interest (e.g., antigen or immunogen).

An "effective amount" of the NAV composition is provided based, at least in part, on the target tissue, target cell type, means of administration, physical characteristics of the polynucleotide (e.g., size, and extent of modified nucleosides) and other components of the NAV, and other determinants. In general, an effective amount of the NAV composition provides an induced or boosted immune response as a function of antigen production in the cell, preferably more efficient than a composition containing a corresponding unmodified polynucleotide encoding the same antigen. Increased antigen production may be demonstrated by increased cell transfection (i.e., the percentage of cells transfected with the NAV), increased protein translation from the polynucleotide, decreased nucleic acid degradation (as demonstrated, e.g., by increased duration of protein translation from a modified polynucleotide), or altered innate immune response of the host cell.

Aspects of the invention are directed to methods of inducing in vivo translation of a polypeptide antigen in a mammalian subject in need thereof. Therein, an effective amount of a NAV composition containing a polynucleotide that has at least one structural or chemical modification and a translatable region encoding the polypeptide (e.g., antigen or immunogen) is administered to the subject using the delivery methods described herein. The polynucleotide is provided in an amount and under other conditions such that the polynucleotide is translated in the cell. The cell in which the polynucleotide is localized, or the tissue in which the cell is present, may be targeted with one or more than one rounds of NAV administration.

In certain embodiments, the administered NAVs comprising polynucleotides directs production of one or more polypeptides that provide a functional immune system-related activity which is substantially absent in the cell, tissue or organism in which the polypeptide is translated. For example, the missing functional activity may be enzymatic, structural, or gene regulatory in nature. In related embodiments, the administered polynucleotides directs production of one or more polypeptides that increases (e.g., synergistically) a functional activity related to the immune system which is present but substantially deficient in the cell in which the polypeptide is translated.

Additionally, the polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The proteins described herein may be engineered for localization within the cell, potentially within a specific compartment such as the cytoplasms or nucleus, or are engineered for secretion from the cell or translocation to the plasma membrane of the cell.

In some embodiments, polynucleotides of the NAVs and their encoded polypeptides in accordance with the present invention may be used for treatment of any of a variety of diseases, disorders, and/or conditions, including but not limited to viral infections (e.g., influenza, HIV, HCV, RSV), parasitic infections or bacterial infections.

The subject to whom the therapeutic agent may be administered suffers from or may be at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

The agents can be administered simultaneously, for example in a combined unit dose (e.g., providing simultaneous delivery of both agents). The agents can also be administered at a specified time interval, such as, but not limited to, an interval of minutes, hours, days or weeks. Generally, the agents may be concurrently bioavailable, e.g., detectable, in the subject. In some embodiments, the agents may be administered essentially simultaneously, for example two unit dosages administered at the same time, or a combined unit dosage of the two agents. In other embodiments, the agents may be delivered in separate unit dosages. The agents may be administered in any order, or as one or more preparations that includes two or more agents. In a preferred embodiment, at least one administration of one of the agents, e.g., the first agent, may be made within minutes, one, two, three, or four hours, or even within one or two days of the other agent, e.g., the second agent. In some embodiments, combinations can achieve synergistic results, e.g., greater than additive results, e.g., at least 25, 50, 75, 100, 200, 300, 400, or 500% greater than additive results.

Modulation of the Immune Response

Activation of the Immune Response

According to the present invention, the NAVs comprising the polynucleotides disclosed herein, e.g., comprising RNA polynucleotides, may act as a single composition as a vaccine. As used herein, a "vaccine" refers to a composition, for example, a substance or preparation that stimulates, induces, causes or improves immunity in an organism, e.g., an animal organism, for example, a mammalian organism (e.g., a human.) Preferably, a vaccine provides immunity against one or more diseases or disorders in the organism, including prophylactic and/or therapeutic immunity. Exemplary vaccines includes one or more agents that resembles an infectious agent, e.g., a disease-causing microorganism, and can be made, for example, from live, attenuated, modified, weakened or killed forms of disease-causing microorganisms, or antigens derived therefrom, including combinations of antigenic components. In exemplary embodiments, a vaccine stimulates, induces causes or improves immunity in an organism or causes or mimics infection in the organism without inducing any disease or disorder. A vaccine introduces an antigen into the tissues, extracellular space or cells of a subject and elicits an immune response, thereby protecting the subject from a particular disease or pathogen infection. The polynucleotides of the present invention may encode an antigen and when the polynucleotides are expressed in cells, a desired immune response is achieved.

NAVs may be administered prophylactically or therapeutically as part of an active immunization scheme to healthy individuals or early in infection during the incubation phase or during active infection after onset of symptoms.

The NAVs of the present invention may also be administered as a second line treatment after the standard first line treatments such as antibiotics and antivirals have failed to induce passive immunity. In this regard, the NAVs of the present invention are useful in settings where resistance to first line treatments has developed and disease persists and induces chronic disease.

NAVs may be administered as part of a treatment regimen for latent bacterial infections, such as MRSA or *Clostridium* infections. In this embodiment, one or more polynucleotides are administered which ultimately produce proteins which result in the removal or alterations of the protective shield surrounding a bacterium making the bacterium more susceptible to antibiotic treatment.

In one embodiment, a polynucleotide encoding one or several generic or patient-specific antibiotic resistance genes is administered to a patient, e.g. NDM-1. The polynucleotide is then translated to produce the enzyme in vivo. This production may raise an antibody-mediated immune response to the secreted and/or the intracellular enzyme that neutralized the antibiotic resistance and provides the bacteria susceptible to the clearance by available antibiotics again. Given the broad range of mutations and variants in antibiotic resistance genes, it would be possible to sequence the specific bacteria genes hosted by the patients and design the exact vaccine for the specific variant in the infected patient.

The use of RNA in or as a vaccine overcomes the disadvantages of conventional genetic vaccination involving incorporating DNA into cells in terms of safeness, feasibility, applicability, and effectiveness to generate immune responses. RNA molecules are considered to be significantly safer than DNA vaccines, as RNAs are more easily degraded. They are cleared quickly out of the organism and cannot integrate into the genome and influence the cell's gene expression in an uncontrollable manner. It is also less likely for RNA vaccines to cause severe side effects like the generation of autoimmune disease or anti-DNA antibodies (Bringmann A. et al., Journal of Biomedicine and Biotechnology (2010), vol. 2010, article ID623687). Transfection with RNA requires only insertion into the cell's cytoplasm, which is easier to achieve than into the nucleus. However, RNA is susceptible to RNase degradation and other natural decomposition in the cytoplasm of cells.

Various attempts to increase the stability and shelf life of RNA vaccines. US 2005/0032730 to Von Der Mulbe et al. discloses improving the stability of mRNA vaccine compositions by increasing G(guanosine)/C(cytosine) content of the mRNA molecules. U.S. Pat. No. 5,580,859 to Felgner et al. teaches incorporating polynucleotide sequences coding for regulatory proteins that binds to and regulates the stabilities of mRNA. While not wishing to be bound by theory, it is believed that the polynucleotides vaccines (NAVs) of the invention will result in improved stability and therapeutic efficacy due at least in part to the specificity, purity and selectivity of the construct designs.

Additionally, certain modified nucleosides, or combinations thereof, when introduced into the polynucleotides of the NAVs of the invention will activate the innate immune response. Such activating molecules are useful as adjuvants when combined with polypeptides and/or other vaccines. In certain embodiments, the activating molecules contain a translatable region which encodes for a polypeptide sequence useful as a vaccine, thus providing the ability to be a self-adjuvant.

In one embodiment, the polynucleotides of the NAVs of the present invention may be used in the prevention, treatment and diagnosis of diseases and physical disturbances caused by infectious agents. The polynucleotide of the present invention may encode at least one polypeptide of interest (antigen) and may be provided to an individual in order to stimulate the immune system to protect against the disease-causing agents. As a non-limiting example, the biological activity and/or effect from an antigen or infectious agent may be inhibited and/or abolished by providing one or more polynucleotides which have the ability to bind and neutralize the antigen and/or infectious agent.

As a non-limiting example, the polynucleotides encoding an immunogen may be delivered to cells to trigger multiple innate response pathways (see International Pub. No. WO2012006377 and US Patent Publication No. US20130177639; herein incorporated by reference in its entirety). As another non-limiting example, the polynucleotides of the NAVs of the present invention encoding an immunogen may be delivered to a vertebrate in a dose amount large enough to be immunogenic to the vertebrate (see International Pub. No. WO2012006372 and WO2012006369 and US Publication No. US20130149375 and US20130177640; the contents of each of which are herein incorporated by reference in their entirety).

A non-limiting list of infectious diseases that the polynucleotide vaccines may treat includes, viral infectious diseases such as AIDS (HIV), HIV resulting in mycobacterial infection, AIDS related Cacheixa, AIDS related Cytomegalovirus infection, HIV-associated nephropathy, Lipodystrophy, AID related cryptococcal meningitis, AIDS related neutropaenia, *Pneumocysitis jiroveci* (*Pneumocystis carinii*) infections, AID related toxoplasmosis, hepatitis A, B, C, D or E, herpes, herpes zoster (chicken pox), German measles (rubella virus), yellow fever, dengue fever etc. (flavi viruses), flu (influenza viruses), haemorrhagic infectious diseases (Marburg or Ebola viruses), bacterial infectious diseases such as Legionnaires' disease (*Legionella*), gastric ulcer (*Helicobacter*), cholera (*Vibrio*), *E. coli* infections, staphylococcal infections, *salmonella* infections or streptococcal infections, tetanus (*Clostridium tetani*), protozoan infectious diseases (malaria, sleeping sickness, leishmaniasis, toxoplasmosis, i.e. infections caused by *plasmodium*, trypanosomes, *leishmania* and *toxoplasma*), diphtheria, leprosy, measles, pertussis, rabies, tetanus, tuberculosis, typhoid, varicella, diarrheal infections such as Amoebiasis, *Clostridium difficile*-associated diarrhea (CDAD), Cryptosporidiosis, Giardiasis, Cyclosporiasis and Rotaviral gastroenteritis, encephalitis such as Japanese encephalitis, Wester equine encephalitis and Tick-borne encephalitis (TBE), fungal skin diseases such as candidiasis, onychomycosis, Tinea captis/scal ringworm, Tinea corporis/body ringworm, Tinea cruris/jock itch, sporotrichosis and Tinea pedis/Athlete's foot, Meningitis such as *Haemophilus influenza* type b (Hib), Meningitis, viral, meningococcal infections and pneumococcal infection, neglected tropical diseases such as Argentine haemorrhagic fever, Leishmaniasis, Nematode/roundworm infections, Ross river virus infection and West Nile virus (WNV) disease, Non-HIV STDs such as Trichomoniasis, Human papillomavirus (HPV) infections, sexually transmitted chlamydial diseases, Chancroid and Syphilis, Non-septic bacterial infections such as cellulitis, lyme disease, MRSA infection, *pseudomonas*, staphylococcal infections, Boutonneuse fever, Leptospirosis, Rheumatic fever, Botulism, Rickettsial disease and Mastoiditis, parasitic infections such as Cysticercosis, Echinococcosis, Trematode/Fluke infections, Trichinellosis, Babesiosis, Hypodermyiasis, Diphyllobothriasis and Trypanosomiasis, respiratory infections such as adenovirus infection, aspergillosis infections, avian (H5N1) influenza, influenza, RSV infections, severe acute respiratory syndrome (SARS), sinusitis, Legionellosis, Coccidioidomycosis and swine (H1N1) influenza, sepsis such as bacteraemia, sepsis/septic shock, sepsis in premature infants, urinary tract infection such as vaginal infections (bacterial), vaginal infections (fungal) and gonococcal infection, viral skin diseases such as B19 parvovirus infections, warts, genital herpes, orofacial herpes, shingles, inner ear infections, fetal cytomegalovirus syndrome, foodborn illnesses such as brucellosis (*Brucella* species), *Clostridium perfringens* (Epsilon toxin), *E. Coli* O157:H7 (*Escherichia coli*), Salmonellosis (*Salmonella* species), Shingellosis (Shingella), Vibriosis and Listeriosis, bioterrorism and potential epidemic diseases such as Ebola haemorrhagic fever, Lassa fever, Marburg haemorrhagic fever, plague, Anthrax Nipah virus disease, Hanta virus, Smallpox, Glanders (*Burkholderia mallei*), Melioidosis (*Burkholderia pseudomallei*), Psittacosis (*Chlamydia psittaci*), Q fever (*Coxiella burnetii*), Tularemia (Fancisella *tularensis*), rubella, mumps and polio.

NAVs of the present invention may be utilized in various settings depending on the prevalence of the infection or the degree or level of unmet medical need. As a non-limiting example, the NAVs of the present invention may be utilized to treat and/or prevent influenza infection, i.e. diseases and conditions related to influenza virus infection (seasonal and pandemic).

Symptoms of the influenza infection include dry cough, fever, chills, myalgias progressing to respiratory failure and the risk of secondary bacterial infections (e.g., MRSA). Seasonal influenza is ubiquitous and consists of three principal strains (A [H1N1], A [H3N2], and B), which are covered by the annual vaccine. Pandemic flu occurs because the viruses' unique reassortment ability allowing antigenic shift as well as transfer between avian and swine flu strains. One emerging concern in Southeast Asia is the pandemic potential of several new strains. Such pandemic outbreaks have a high mortality rate with few available treatments. Anti-virals only provide symptomatic relief and must be given in the first 48 hours.

The NAVs of the present invention have superior properties in that they produce much larger antibody titers, produce responses early than commercially available anti-virals and may be administered after the critical 48 hour period while retaining efficacy.

While not wishing to be bound by theory, the inventors hypothesize that the NAVs of the invention, as mRNA polynucleotides, are better designed to produce the appropriate protein conformation on translation as the NAVs co-opt natural cellular machinery. Unlike traditional vaccines which are manufactured ex vivo and may trigger unwanted cellular responses, the NAVs are presented to the cellular system in a more native fashion. Adding to the superior effects may also involve the formulations utilized which may neither serve to shield nor traffic the NAVs.

According to the present invention, NAVs represent a tailored active vaccine that not only can prevent infection but can limit transmission of influenza.

In some embodiments, the NAVs may be used to prevent pandemic influenza by reacting to emerging new strains with the very rapid NAV-based vaccine production process. In some embodiments, new NAV for treating or prophylactically preventing influenza outbreaks, including for emerging strains (e.g., H10N8), may be produced in less than six weeks, from the time of antigen identification to available vaccine.

In some embodiments a single injection of a single antigen encoding NAV polynucleotide may provide protection for an entire flu season.

The polynucleotides of the NAVs of the invention are not self-replicating RNA. Self-replicating RNA have been described, for instance in US Pub. No. US20110300205 and International Pub. No. WO2011005799 and WO2013055905, the contents of each of which are herein incorporated by reference in their entirety.

In one embodiment, the polynucleotides of the NAVs of the invention may encode amphipathic and/or immunogenic amphipathic peptides.

In on embodiment, a formulation of the polynucleotides of the NAVs of the invention may further comprise an amphipathic and/or immunogenic amphipathic peptide. As a non-limiting example, the polynucleotides comprising an amphipathic and/or immunogenic amphipathic peptide may be formulated as described in US. Pub. No. US20110250237 and International Pub. Nos. WO2010009277 and WO2010009065; each of which is herein incorporated by reference in their entirety.

In one embodiment, the polynucleotides of the NAVs of the invention may be immunostimultory. As a non-limiting example, the polynucleotides may encode all or a part of a positive-sense or a negative-sense stranded RNA virus genome (see International Pub No. WO2012092569 and US Pub No. US20120177701, each of which is herein incorporated by reference in their entirety). In another non-limiting example, the immunostimultory polynucleotides of the present invention may be formulated with an excipient for administration as described herein and/or known in the art (see International Pub No. WO2012068295 and US Pub No. US20120213812, each of which is herein incorporated by reference in their entirety). The polynucleotides may further comprise a sequence region encoding a cytokine that promotes the immune response, such as a monokine, lymphokine, interleukin or chemokine, such as IL-1, IL-2, IL-3, IL-4, IL-5, IL-6, IL-7, IL-8, IL-9, IL-10, IL-12, INF-α, INF-γ, GM-CFS, LT-α, or growth factors such as hGH.

In one embodiment, the response of the vaccine formulated by the methods described herein may be enhanced by the addition of various compounds to induce the therapeutic effect. As a non-limiting example, the vaccine formulation may include a MHC II binding peptide or a peptide having a similar sequence to a MHC II binding peptide (see International Pub Nos. WO2012027365, WO2011031298 and US Pub No. US20120070493, US20110110965, each of which is herein incorporated by reference in their entirety). As another example, the vaccine formulations may comprise modified nicotinic compounds which may generate an antibody response to nicotine residue in a subject (see International Pub No. WO2012061717 and US Pub No. US20120114677, each of which is herein incorporated by reference in their entirety).

In one embodiment, the effective amount of the polynucleotides of the NAVs of the invention provided to a cell, a tissue or a subject may be enough for immune prophylaxis.

In one embodiment, the polynucleotides of the NAVs of the invention may be administrated with other prophylactic or therapeutic compounds. As a non-limiting example, the prophylactic or therapeutic compound may be an adjuvant or a booster. As used herein, when referring to a prophylactic composition, such as a vaccine, the term "booster" refers to an extra administration of the prophylactic composition. A booster (or booster vaccine) may be given after an earlier administration of the prophylactic composition. The time of administration between the initial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 18 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years.

In one embodiment, the polynucleotides of the NAVs of the invention may be administered intranasally similar to the administration of live vaccines. In another aspect the polynucleotide may be administered intramuscularly or intradermally similarly to the administration of inactivated vaccines known in the art.

In one embodiment, the NAVs of the invention may be used to protect against and/or prevent the transmission of an emerging or engineered threat which may be known or unknown.

In another embodiment, the NAVs may be formulated by the methods described herein. In one aspect, the formulation may comprise a NAV or polynucleotide which can have a therapeutic and/or prophylactic effect on more than one disease, disorder or condition. As a non-limiting example, the formulation may comprise polynucleotides encoding an antigen, including but not limited to a protein from an infectious agent such as a viral protein, a parasite protein or a bacterial protein.

In addition, the NAV antibodies of the present invention may be used for research in many applications, such as, but not limited to, identifying and locating intracellular and extracellular proteins, protein interaction, signal pathways and cell biology.

In another embodiment, the NAV may be used in to reduce the risk or inhibit the infection of influenza viruses such as, but not limited to, the highly pathogenic avian influenza virus (such as, but not limited to, H5N1 subtype) infection and human influenza virus (such as, but not limited to, H1N1 subtype and H3N2 subtype) infection. The polynucleotide described herein which may encode any of the protein sequences described in U.S. Pat. No. 8,470,771, the contents of which are herein incorporated by reference in its entirety, may be used in the treatment or to reduce the risk of an influenza infection.

In one embodiment, the NAV may be used to as a vaccine or modulating the immune response against a protein produced by a parasite. Bergmann-Leitner et al. in U.S. Pat. No. 8,470,560, the contents of which are herein incorporated by reference in its entirety, describe a DNA vaccine against the circumsporozoite protein (CSP) of malaria parasites. As a non-limiting example, the polynucleotide may encode the CR2 binding motif of C3d and may be used a vaccine or therapeutic to modulate the immune system against the CSP of malaria parasites.

In one embodiment, the NAV may be used as a vaccine and may further comprise an adjuvant which may enable the vaccine to elicit a higher immune response. As a non-limiting example, the adjuvant could be a sub-micron oil-in-water emulsion which can elicit a higher immune response in human pediatric populations (see e.g., the adjuvanted vaccines described in US Patent Publication No. US20120027813 and U.S. Pat. No. 8,506,966, the contents of each of which are herein incorporated by reference in its entirety).

II. Infectious Agents and Antigens

NAVs of the present invention may be used to protect, treat or cure infection arising from contact with an infectious agent, e.g., microorganism. Infectious agents include bacteria, viruses, fungi, protozoa and parasites.

A. Managing Infection

In one embodiment, provided are methods for treating or preventing a microbial infection (e.g., a bacterial infection) and/or a disease, disorder, or condition associated with a microbial or viral infection, or a symptom thereof, in a subject, by administering a NAV comprising one or more polynucleotide encoding an anti-microbial polypeptide. The administration may be in combination with an anti-microbial agent (e.g., an anti-bacterial agent), e.g., an anti-microbial polypeptide or a small molecule anti-microbial compound described herein. The anti-microbial agents include, but are not limited to, anti-bacterial agents, anti-viral agents, anti-fungal agents, anti-protozoal agents, anti-parasitic agents, and anti-prion agents.

Conditions Associated with Bacterial Infection

Diseases, disorders, or conditions which may be associated with bacterial infections which may be treated using the NAVs of the invention include, but are not limited to one or more of the following: abscesses, actinomycosis, acute prostatitis, *aeromonas hydrophila*, annual ryegrass toxicity, anthrax, bacillary peliosis, bacteremia, bacterial gastroenteritis, bacterial meningitis, bacterial pneumonia, bacterial vaginosis, bacterium-related cutaneous conditions, bartonellosis, BCG-oma, botryomycosis, botulism, Brazilian purpuric fever, Brodie abscess, brucellosis, Buruli ulcer, campylobacteriosis, caries, Carrion's disease, cat scratch disease, cellulitis, *chlamydia* infection, cholera, chronic bacterial prostatitis, chronic recurrent multifocal osteomyelitis, clostridial necrotizing enteritis, combined periodontic-endodontic lesions, contagious bovine pleuropneumonia, diphtheria, diphtheritic stomatitis, ehrlichiosis, erysipelas, piglottitis, erysipelas, Fitz-Hugh-Curtis syndrome, flea-borne spotted fever, foot rot (infectious pododermatitis), Garre's sclerosing osteomyelitis, Gonorrhea, Granuloma inguinale, human granulocytic anaplasmosis, human monocytotropic ehrlichiosis, hundred days' cough, impetigo, late congenital syphilitic oculopathy, legionellosis, Lemierre's syndrome, leprosy (Hansen's Disease), leptospirosis, listeriosis, Lyme disease, lymphadenitis, melioidosis, meningococcal disease, meningococcal septicaemia, methicillin-resistant *Staphylococcus aureus* (MRSA) infection, *mycobacterium avium-intracellulare* (MAI), mycoplasma pneumonia, necrotizing fasciitis, nocardiosis, noma (cancrum oris or gangrenous stomatitis), omphalitis, orbital cellulitis, osteomyelitis, overwhelming post-splenectomy infection (OPSI), ovine brucellosis, pasteurellosis, periorbital cellulitis, pertussis (whooping cough), plague, pneumococcal pneumonia, Pott disease, proctitis, *pseudomonas* infection, psittacosis, pyaemia, pyomyositis, Q fever, relapsing fever (typhinia), rheumatic fever, Rocky Mountain spotted fever (RMSF), rickettsiosis, *salmonellosis*, scarlet fever, sepsis, *serratia* infection, shigellosis, southern tick-associated rash illness, staphylococcal scalded skin syndrome, streptococcal pharyngitis, swimming pool granuloma, swine brucellosis, syphilis, syphilitic aortitis, tetanus, toxic shock syndrome (TSS), trachoma, trench fever, tropical ulcer, tuberculosis, tularemia, typhoid fever, typhus, urogenital tuberculosis, urinary tract infections, vancomycin-resistant *Staphylococcus aureus* infection, Waterhouse-Friderichsen syndrome, *pseudotuberculosis* (*Yersinia*) disease, and yersiniosis Bacterial Pathogens The bacterium described herein can be a Gram-positive bacterium or a Gram-negative bacterium. Bacterial pathogens include, but are not limited to, *Acinetobacter baumannii, Bacillus anthracis, Bacillus subtilis, Bordetella pertussis, Borrelia burgdorferi, Brucella abortus, Brucella canis, Brucella melitensis, Brucella suis, Campylobacter jejuni, Chlamydia pneumoniae, Chlamydia trachomatis, Chlamydophila psittaci, Clostridium botulinum, Clostridium difficile, Clostridium perfringens, Clostridium tetani*, coagulase Negative *Staphylococcus, Corynebacterium diphtheria, Enterococcus faecalis, Enterococcus faecium, Escherichia coli*, enterotoxigenic *Escherichia coli* (ETEC), enteropathogenic *E. coli, E. coli* O157:H7, *Enterobacter* sp., *Francisella tularensis, Haemophilus influenzae, Helicobacter pylori, Klebsiella pneumoniae, Legionella pneumophila, Leptospira interrogans, Listeria monocytogenes, Moraxella catarralis, Mycobacterium leprae, Mycobacterium tuberculosis, Mycoplasma pneumoniae, Neisseria gonorrhoeae, Neisseria meningitides, Preteus mirabilis, Proteus* sps., *Pseudomonas aeruginosa, Rickettsia rickettsii, Salmonella typhi, Salmonella typhimurium, Serratia marcesens, Shigella flexneri, Shigella sonnei, Staphylococcus aureus, Staphylococcus epidermidis, Staphylococcus saprophyticus, Streptococcus agalactiae, Streptococcus mutans, Streptococcus pneumoniae, Streptococcus pyogenes, Treponema pallidum, Vibrio cholerae*, and *Yersinia pestis*.

Bacterial pathogens may also include bacteria that cause resistant bacterial infections, for example, clindamycin-resistant *Clostridium difficile*, fluoroquinolon-resistant *Clostridium difficile*, methicillin-resistant *Staphylococcus aureus* (MRSA), multidrug-resistant *Enterococcus faecalis*, multidrug-resistant *Enterococcus faecium*, multidrug-resistance *Pseudomonas aeruginosa*, multidrug-resistant *Acinetobacter baumannii*, and vancomycin-resistant *Staphylococcus aureus* (VRSA).

Antibiotic Combinations

In one embodiment, the NAVs of the present invention, e.g., NAVs comprising one or more antigen-encoding polynucleotides of the present invention, may be administered in conjunction with one or more antibiotics.

Antibacterial Agents

Anti-bacterial agents include, but are not limited to, aminoglycosides (e.g., amikacin (AMIKIN®), gentamicin (GARAMYCIN®), kanamycin (KANTREX®), neomycin (MYCIFRADIN®), netilmicin (NETROMYCIN®), tobramycin (NEBCIN®), Paromomycin (HUMATIN®)), ansamycins (e.g., geldanamycin, herbimycin), carbacephem (e.g., loracarbef (LORABID®), Carbapenems (e.g., ertapenem (INVANZ®), doripenem (DORIBAX®), imipenem/cilastatin (PRIMAXIN®), meropenem (MERREM®), cephalosporins (first generation) (e.g., cefadroxil (DURICEF®), cefazolin (ANCEF®), cefalotin or cefalothin (KEFLIN®), cefalexin (KEFLEX®), cephalosporins (second generation) (e.g., cefaclor (CECLOR®), cefamandole (MANDOL®), cefoxitin (MEFOXIN®), cefprozil (CEFZIL®), cefuroxime (CEFTIN®, ZINNAT®)), cephalosporins (third generation) (e.g., cefixime (SUPRAX®), cefdinir (OMNICEF®, CEFDIEL®), cefditoren (SPECTRACEF®), cefoperazone (CEFOBID®), cefotaxime (CLAFORAN®), cefpodoxime (VANTIN®), ceftazidime (FORTAZ®), ceftibuten (CEDAX®), ceftizoxime (CEFIZOX®), ceftriaxone (ROCEPHIN®)), cephalosporins (fourth generation) (e.g., cefepime (MAXIPIME®)), cephalosporins (fifth generation) (e.g., ceftobiprole (ZEFTERA®)), glycopeptides (e.g., teicoplanin (TARGOCID®), vancomycin (VANCOCIN®), telavancin (VIBATIV®)), lincosamides (e.g., clindamycin (CLEOCIN®), lincomycin (LINCOCIN®)), lipopeptide (e.g., daptomycin (CUBICIN®)), macrolides (e.g., azithromycin (ZITHROMAX®, SUMAMED®, ZITROCIN®), clarithromycin (BIAXIN®), dirithromycin (DYNABAC®), erythromycin (ERYTHOCIN®, ERYTHROPED®), roxithromycin, troleandomycin (TAO®), telithromycin (KETEK®), spectinomycin (TROBICIN®)), monobactams (e.g., aztreonam (AZACTAM®)), nitrofurans (e.g., furazolidone (FUROXONE®), nitrofurantoin (MACRODANTIN®, MACROBID®), penicillins (e.g., amoxicillin (NOVAMOX®, AMOXIL®), ampicillin (PRINCIPEN®), azlocillin, carbenicillin (GEOCILLIN®), cloxacillin (TEGOPEN®), dicloxacillin (DYNAPEN®), flucloxacillin (FLOXAPEN®), mezlocillin (MEZLIN®), methicillin (STAPHCILLIN®), nafcillin (UNIPEN®), oxacillin (PROSTAPHLIN®), penicillin G (PENTIDS®), penicillin V (PEN-VEE-K®), piperacillin (PIPRACIL®), temocillin (NEGABAN®), ticarcillin (TICAR®)), penicillin combinations (e.g., amoxicillin/clavulanate (AUGMENTIN®), ampicillin/sulbactam (UNASYN®), piperacillin/tazobactam (ZOSYN®), ticarcillin/clavulanate (TIMENTIN®)), polypeptides (e.g., bacitracin, colistin (COLYMYCIN-S®), polymyxin B, quinolones (e.g., ciprofloxacin (CIPRO®, CIPROXIN®, CIPROBAY®), enoxacin (PENETREX®), gatifloxacin (TEQUIN®), levofloxacin (LEVAQUIN®), lomefloxacin (MAXAQUIN®), moxifloxacin (AVELOX®), nalidixic acid (NEGGRAM®), norfloxacin (NOROXIN®), ofloxacin (FLOXIN®, OCUFLOX®), trovafloxacin (TROVAN®), grepafloxacin (RAXAR®), sparfloxacin (ZAGAM®), temafloxacin (OMNIFLOX®)), sulfonamides (e.g., mafenide (SULFAMYLON®), sulfonamidochrysoidine (PRONTOSIL®), sulfacetamide (SULAMYD®, BLEPH-10®), sulfadiazine (MICRO-SULFON®), silver sulfadiazine (SILVADENE®), sulfamethizole (THIOSULFIL FORTE®), sulfamethoxazole (GANTANOL®), sulfanilimide, sulfasalazine (AZULFIDINE®), sulfisoxazole (GANTRISIN®), trimethoprim (PROLOPRIM®), TRIMPEX®), trimethoprim-sulfamethoxazole (co-trimoxazole) (TMP-SMX) (BACTRIM®, SEPTRA®)), tetracyclines (e.g., demeclocycline (DECLOMYCIN®), doxycycline (VIBRAMYCIN®), minocycline (MINOCIN®), oxytetracycline (TERRAMYCIN®), tetracycline (SUMYCIN®, ACHROMYCIN® V, STECLIN®)), drugs against mycobacteria (e.g., clofazimine (LAMPRENE®), dapsone (AVLOSULFON®), capreomycin (CAPASTAT®), cycloserine (SEROMYCIN®), ethambutol (MYAMBUTOL®), ethionamide (TRECATOR®), isoniazid (I.N.H.®), pyrazinamide (ALDINAMIDE®), rifampin (RIFADIN®, RIMACTANE®), rifabutin (MYCOBUTIN®), rifapentine (PRIFTIN®), streptomycin), and others (e.g., arsphenamine (SALVARSAN®), chloramphenicol (CHLOROMYCETIN®), fosfomycin (MONUROL®), fusidic acid (FUCIDIN®), linezolid (ZYVOX®), metronidazole (FLAGYL®), mupirocin (BACTROBAN®), platensimycin, quinupristin/dalfopristin (SYNERCID®), rifaximin (XIFAXAN®), thiamphenicol, tigecycline (TIGACYL®), tinidazole (TINDAMAX®, FASIGYN®)).

Conditions Associated with Viral Infection

In another embodiment, provided are methods for treating or preventing a viral infection and/or a disease, disorder, or condition associated with a viral infection, or a symptom thereof, in a subject, by administering aRNAV comprising one or more polynucleotides encoding an anti-viral polypeptide, e.g., an anti-viral polypeptide described herein in combination with an anti-viral agent, e.g., an anti-viral polypeptide or a small molecule anti-viral agent described herein.

Diseases, disorders, or conditions associated with viral infections which may be treated using the NAVs of the invention include, but are not limited to, acute febrile pharyngitis, pharyngoconjunctival fever, epidemic keratoconjunctivitis, infantile gastroenteritis, Coxsackie infections, infectious mononucleosis, Burkitt lymphoma, acute hepatitis, chronic hepatitis, hepatic cirrhosis, hepatocellular carcinoma, primary HSV-1 infection (e.g., gingivostomatitis in children, tonsillitis and pharyngitis in adults, keratoconjunctivitis), latent HSV-1 infection (e.g., herpes labialis and cold sores), primary HSV-2 infection, latent HSV-2 infection, aseptic meningitis, infectious mononucleosis, Cytomegalic inclusion disease, Kaposi sarcoma, multicentric Castleman disease, primary effusion lymphoma, AIDS, influenza, Reye syndrome, measles, postinfectious encephalomyelitis, Mumps, hyperplastic epithelial lesions (e.g., common, flat, plantar and anogenital warts, laryngeal papillomas, epidermodysplasia verruciformis), cervical carcinoma, squamous cell carcinomas, croup, pneumonia, bronchiolitis, common cold, Poliomyelitis, Rabies, bronchiolitis, pneumonia, influenza-like syndrome, severe bronchiolitis with pneumonia, German measles, congenital rubella, Varicella, and herpes zoster.

Viral Pathogens

Examples of viral infectious agents include, but are not limited to, adenovirus; Herpes simplex, type 1; Herpes simplex, type 2; encephalitis virus, papillomavirus, Varicella-zoster virus; Epstein-barr virus; Human cytomegalovirus; Human herpesvirus, type 8; Human papillomavirus; BK virus; JC virus; Smallpox; polio virus, Hepatitis B virus; Human bocavirus; Parvovirus B19; Human astrovirus; Norwalk virus; coxsackievirus; hepatitis A virus; poliovirus; rhinovirus; Severe acute respiratory syndrome virus; Hepatitis C virus; yellow fever virus; dengue virus; West Nile virus; Rubella virus; Hepatitis E virus; Human immunodeficiency virus (HIV); Influenza virus, type A or B; Guanarito virus; Junin virus; Lassa virus; Machupo virus; Sabiá virus; Crimean-Congo hemorrhagic fever virus; Ebola virus; Marburg virus; Measles virus; Mumps virus; Parainfluenza virus; Respiratory syncytial virus; Human metapneumovirus; Hendra virus; Nipah virus; Rabies virus; Hepatitis D; Rotavirus; Orbivirus; Coltivirus; Hantavirus, Middle East Respiratory Coronavirus; Chikungunya virus or Banna virus.

Viral pathogens may also include viruses that cause resistant viral infections.

Antiviral Agents

Exemplary anti-viral agents include, but are not limited to, abacavir (ZIAGEN®), abacavir/lamivudine/zidovudine (Trizivir®), aciclovir or acyclovir (CYCLOVIR®, HERPEX®, ACIVIR®, ACIVIRAX®, ZOVIRAX®, ZOVIR®), adefovir (Preveon®, Hepsera®), amantadine (SYMMETREL®), amprenavir (AGENERASE®), ampligen, arbidol, atazanavir (REYATAZ®), boceprevir, cidofovir, darunavir (PREZISTA®), delavirdine (RESCRIPTOR®), didanosine (VIDEX®), docosanol (ABREVA®), edoxudine, efavirenz (SUSTIVA®, STOCRIN®), emtricitabine (EMTRIVA®), emtricitabine/tenofovir/efavirenz (ATRIPLA®), enfuvirtide (FUZEON®), entecavir (BARACLUDE®, ENNAVIR®), famciclovir (FAMVIR®), fomivirsen (VITRAVENE®), fosamprenavir (LEXIVA®, TELZIR®), foscarnet (FOSCAVIR®), fosfonet, ganciclovir (CYTOVENE®, CYMEVENE®, VITRASERT®), GS 9137 (ELVITEGRAVIR®), imiquimod (ALDARA®, ZYCLARA®, BESELNA®), indinavir (CRIXIVAN®), inosine, inosine pranobex (IMUNOVIR®), interferon type I, interferon type II, interferon type III, kutapressin (NEXAVIR®), lamivudine (ZEFFIX®, HEPTOVIR®, EPIVIR®), lamivudine/zidovudine (COMBIVIR®), lopinavir, loviride, maraviroc (SELZENTRY®, CELSENTRI®), methisazone, MK-2048, moroxydine, nelfinavir (VIRACEPT®), nevirapine (VIRAMUNE®), oseltamivir (TAMIFLU®), peginterferon alfa-2a (PEGASYS®), penciclovir (DENAVIR®), peramivir, pleconaril, podophyllotoxin (CONDYLOX®), raltegravir (ISENTRESS®), ribavirin (COPEGUs®, REBETOL®, RIBASPHERE®, VILONA® AND VIRAZOLE®), rimantadine (FLUMADINE®), ritonavir (NORVIR®), pyramidine, saquinavir (INVIRASE®, FORTOVASE®), stavudine, tea tree oil (*melaleuca* oil), tenofovir (VIREAD®), tenofovir/emtricitabine (TRUVADA®), tipranavir (APTIVUS®), trifluridine (VIROPTIC®), tromantadine (VIRUMERZ®), valaciclovir (VALTREX®), valganciclovir (VALCYTE®), vicriviroc, vidarabine, viramidine, zalcitabine, zanamivir (RELENZA®), and zidovudine (azidothymidine (AZT), RETROVIR®, RETROVIS®).

Conditions Associated with Fungal Infections

Diseases, disorders, or conditions associated with fungal infections which may be treated using the NAVs of the invention include, but are not limited to, aspergilloses, blastomycosis, candidasis, coccidioidomycosis, cryptococcosis, histoplasmosis, mycetomas, paracoccidioidomycosis, and tinea pedis. Furthermore, persons with immuno-deficiencies are particularly susceptible to disease by fungal genera such as *Aspergillus, Candida, Cryptoccocus, Histoplasma*, and *Pneumocystis*. Other fungi can attack eyes, nails, hair, and especially skin, the so-called dermatophytic fungi and keratinophilic fungi, and cause a variety of conditions, of which ringworms such as athlete's foot are common. Fungal spores are also a major cause of allergies, and a wide range of fungi from different taxonomic groups can evoke allergic reactions in some people.

Fungal Pathogens

Fungal pathogens include, but are not limited to, Ascomycota (e.g., *Fusarium oxysporum, Pneumocystis jirovecii, Aspergillus* spp., *Coccidioides immitis*/posadasii, *Candida albicans*), Basidiomycota (e.g., *Filobasidiella neoformans, Trichosporon*), Microsporidia (e.g., *Encephalitozoon cuniculi, Enterocytozoon bieneusi*), and Mucoromycotina (e.g., *Mucor circinelloides, Rhizopus oryzae, Lichtheimia corymbifera*).

Anti Fungal Agents

Exemplary anti-fungal agents include, but are not limited to, polyene antifungals (e.g., natamycin, rimocidin, filipin, nystatin, amphotericin B, candicin, hamycin), imidazole antifungals (e.g., miconazole (MICATIN®, DAKTARIN®), ketoconazole (NIZORAL®, FUNGORAL®, SEBIZOLE®), clotrimazole (LOTRIMIN®, LOTRIMIN® AF, CANESTEN®), econazole, omoconazole, bifonazole, butoconazole, fenticonazole, isoconazole, oxiconazole, sertaconazole (ERTACZO®), sulconazole, tioconazole), triazole antifungals (e.g., albaconazole fluconazole, itraconazole, isavuconazole, ravuconazole, posaconazole, voriconazole, terconazole), thiazole antifungals (e.g., abafungin), allylamines (e.g., terbinafine (LAMISIL®), naftifine (NAFTIN®), butenafine (LOTRIMIN® Ultra)), echinocandins (e.g., anidulafungin, caspofungin, micafungin), and others (e.g., polygodial, benzoic acid, ciclopirox, tolnaftate (TINACTIN®, DESENEX®, AFTATE®), undecylenic acid, flucytosine or 5-fluorocytosine, griseofulvin, haloprogin, sodium bicarbonate, allicin).

Conditions Associated with Protozoal Infection

Diseases, disorders, or conditions associated with protozoal infections which may be treated using the NAVs of the invention include, but are not limited to, amoebiasis, giardiasis, trichomoniasis, African Sleeping Sickness, American Sleeping Sickness, leishmaniasis (Kala-Azar), balantidiasis, toxoplasmosis, malaria, *acanthamoeba keratitis*, and babesiosis.

Protozoan Pathogens

Protozoal pathogens include, but are not limited to, *Entamoeba histolytica, Giardia lambila, Trichomonas vaginalis, Trypanosoma brucei, T. cruzi, Leishmania donovani, Balantidium coli, Toxoplasma gondii, Plasmodium* spp., and *Babesia microti*.

Anti-Protozoan Agents

Exemplary anti-protozoal agents include, but are not limited to, eflornithine, furazolidone (FUROXONE®, DEPENDAL-M®), melarsoprol, metronidazole (FLAGYL®), ornidazole, paromomycin sulfate (HUMATIN®), pentamidine, pyrimethamine (DARAPRIM®), and tinidazole (TINDAMAX®, FASIGYN®).

Conditions Associated with Parasitic Infection

Diseases, disorders, or conditions associated with parasitic infections which may be treated using the NAVs of the invention include, but are not limited to, *acanthamoeba keratitis*, amoebiasis, ascariasis, babesiosis, balantidiasis, baylisascariasis, chagas disease, clonorchiasis, *cochliomyia*, cryptosporidiosis, diphyllobothriasis, dracunculiasis, echinococcosis, elephantiasis, enterobiasis, fascioliasis, fasciolopsiasis, filariasis, giardiasis, gnathostomiasis, hymenolepiasis, isosporiasis, katayama fever, leishmaniasis, lyme disease, malaria, metagonimiasis, myiasis, onchocerciasis, pediculosis, scabies, schistosomiasis, sleeping sickness, strongyloidiasis, taeniasis, toxocariasis, toxoplasmosis, trichinosis, and trichuriasis.

Parasitic Pathogens

Parasitic pathogens include, but are not limited to, *Acanthamoeba, Anisakis, Ascaris lumbricoides*, botfly, *Balantidium coli*, bedbug, Cestoda, chiggers, *Cochliomyia hominivorax, Entamoeba histolytica, Fasciola hepatica, Giardia lamblia*, hookworm, *Leishmania, Linguatula serrata*, liver fluke, *Loa boa, Paragonimus*, pinworm, *Plasmodium falciparum, Schistosoma, Strongyloides stercoralis*, mite, tapeworm, *Toxoplasma gondii, Trypanosoma*, whipworm, *Wuchereria bancrofti*.

Anti Parasitic Agents

Exemplary anti-parasitic agents include, but are not limited to, antinematodes (e.g., mebendazole, pyrantel pamoate, thiabendazole, diethylcarbamazine, ivermectin), anticestodes (e.g., niclosamide, praziquantel, albendazole), antitrematodes (e.g., praziquantel), antiamoebics (e.g., rifampin, amphotericin B), and antiprotozoals (e.g., melarsoprol, eflornithine, metronidazole, tinidazole).

B. Therapeutic Settings and/or Situations

NAVs of the present invention may be utilized in various settings depending on the prevalence of the infection or the degree or level of unmet medical need. Some applications of the NAVs of the invention are outlined in Table 1.

TABLE 1

Infectious Agents by prevalence and Medical Need

| | Unmet Need (Infectious Agent Target) | | |
|---|---|---|---|
| Prevalence | Short term benign Long term sequelae | Short term morbidity but some treatment | Short term mortality; no treatment available |
| Ubiquitous | HPV, HCV, UTRIs | Dengue, Chikungunya, ETEC and GI bacteria and *S. Pneumo* PNA | seasonal and pandemic influenza, MRSA and TB |
| At risk populations | VZV, Lyme and *Chlamydia*, *N. gonorrhea* and HSV | Noroviruses, HEV, CMV, HIV and *N. meningitis* | *Klebsiella*, *Pseudomonas*, Rabies and *C. difficile* |
| Rare disease | — | VEV | toxin-mediated diseases, hantavirus, arborviruses such as JE, WNV and EEE |

Certain abbreviations include:
HPV—Human Papillomavirus;
HCV—Hepatitis C Virus;
HEV—Human Enterovirus;
MERS-CoV: Middle East Respiratory Syndrom Corona Virus;
VZV—Varicella-zoster Virus;
MRSA—Methicillin-resistant *Staph areus*;
TB—tuberculosis;
WNV—West Nile Virus;
VEV—vesicular exanthema virus;
EEE—Eastern equine encephalitis,
JE—Japanese encephalitis,
ETEC—Enterotoxigenic *E. coli*.

Influenza (Seasonal and Pandemic)

Symptoms of the flu include dry cough, fever, chills, myalgias progressing to respiratory failure and the risk of secondary bacterial infections (e.g., MRSA). Seasonal influenza is ubiquitous and consists of three principal strains (A [H1N1], A [H3N2], and B), which are covered by the annual vaccine. Pandemic flu occurs because the viruses' unique reassortment ability allowing antigenic shift as well as transfer between avian and swine flu strains. One emerging concern in Southeast Asia is the pandemic potential of several new strains. Such pandemic outbreaks have a high mortality rate with few available treatments. Anti-virals only provide symptomatic relief and must be given in the first 48 hours.

The NAVs of the present invention have superior properties in that they produce much larger antibody titers, produce responses early than commercially available anti-virals and may be administered after the critical 48 hour period while retaining efficacy.

While not wishing to be bound by theory, the inventors hypothesize that the NAVs of the invention, as mRNA polynucleotides, are better designed to produce the appropriate protein conformation on translation as the NAVs co-opt natural cellular machinery. Unlike traditional vaccines which are manufactured ex vivo and may trigger unwanted cellular responses, the NAVs are presented to the cellular system in a more native fashion. Adding to the superior effects may also involve the formulations utilized which may either serve to shield or traffic the NAVs.

According to the present invention, NAVs represent a tailored active vaccine that not only can prevent infection but can limit transmission of influenza.

In some embodiments, the NAVs may be used to prevent pandemic influenza by reacting to emerging new strains with the very rapid NAV-based vaccine production process. In some embodiments, new NAV for treating or prophylactically preventing influenza outbreaks, including for emerging strains (e.g., H7N9 and H10N8), may be produced in less than six weeks, from the time of antigen identification to available vaccine.

In some embodiments a single injection of a single antigen encoding NAV polynucleotide may provide protection for an entire flu season.

Influenza: Maintenance of Antigenic Memory

The NAV compositions of the present invention may also be used to maintain or restore antigenic memory in a subject or population as part of a vaccination plan.

With the speed and versatility of the NAV technology of the present invention, it is now possible to create a vaccination plan that spans both temporal and viral strain space.

In one embodiment, NAV compositions may be created which include polynucleotides that encode one or more flu year antigens. As used herein a flu year antigen is an antigen which is selected from a strain of influenza used as a component of a flu vaccine from a particular year. For example, the influenza A strain, A/Port Chalmers/1/1973 (H3N2)-like virus, represents one strain component of the Northern Hemisphere vaccine from 1974-1975.

According to the present invention, a vaccination scheme or plan is developed which allows for not only ongoing vaccination in the current year but antigenic memory booster vaccinations across years, strains, or groups thereof to establish and maintain antigenic memory in a population. In this manner, a population is less likely to succumb to any pandemic or outbreak involving recurrence of older strains or the appearance of antigens from older strains.

Any combination of prior vaccine component strains utilized to create or design an antigenic memory booster vaccine is referred to here as a reference set.

In one embodiment, NAVs which are antigenic memory booster vaccines are administered to boost antigenic memory across a time period of 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more years.

In one embodiment, NAVs which are antigenic memory booster vaccines are administered to boost antigenic memory for alternating historic years including every other year from the past vaccine component strains relative to a current year. In some embodiments the selection of the vaccine components can be from every $3^{rd}$, $4^{th}$, $5^{th}$, $6^{th}$, $7^{th}$, $8^{th}$, $9^{th}$, $10^{th}$ or more years.

In one embodiment, NAVs which are antigenic memory booster vaccines are administered to boost antigenic memory over ten year periods.

In some embodiments NAVs which are antigenic memory booster vaccines are administered to boost antigenic memory and are selected from a number of influenza type A strains as a first selection combined with a selection from a number of influenza type B strains or other strains listed herein. The number of selections of type A or type B may be independently, 1, 2, 1, 4, 5, 6, 7, 8, 9, 10 or more.

In all cases, the antigenic memory booster vaccine strains for antigen encoding in the NAVs may be selected from either the Northern or Southern hemisphere vaccine components independently.

In some embodiments, the NAV booster vaccine may be used in a population either once or periodically to create herd immunity. Such immunity is present when greater than 30% of a population is protected.

The components or strains of influenza which may be utilized in the antigenic memory booster vaccines include, but are not limited to, those in Tables 2-5.

TABLE 2

Influenza vaccine components by year

| Northern hemisphere | H1N1 | H3N2 | B-strain | additional B-strain for QIV |
|---|---|---|---|---|
| 1974-1975 | N/A | A/Port Chalmers/1/1973(H3N2)-like virus | B/HongKong/05/1972-like virus | N/A |
| 1975-1976 | A/Scotland/840/74-like virus H1N1 | A/Port Chalmers/1/1973(H3N2)-like virus | B/HongKong/05/1972-like virus | N/A |
| 1976-1977 | N/A | A/Victoria/3/75(H3N2)-like virus | B/HongKong/05/1972-like virus | N/A |
| 1977-1978 | N/A | A/Victoria/3/75(H3N2)-like virus | B/HongKong/05/1972-like virus | N/A |
| 1978-1979 | A/USSR/90/77(H1N1)-like virus | A/Texas/1/77(H3N2)-like virus | B/HongKong/05/1972-like virus | N/A |
| 1979-1980 | A/USSR/90/77(H1N1)-like virus | A/Texas/1/77(H3N2)-like virus | N/A | N/A |
| 1980-1981 | A/Brazil/11/78(H1N1)-like virus | A/Bangkok/01/1979 (H3N2)-like virus | B/Singapore/222/79-like virus | N/A |
| 1981-1982 | A/Brazil/11/78(H1N1)-like virus | A/Bangkok/01/1979 (H3N2)-like virus | B/Singapore/222/79-like virus | N/A |
| 1982-1983 | A/Brazil/11/78(H1N1)-like virus | A/Bangkok/01/1979 (H3N2)-like virus | B/Singapore/222/79-like virus | N/A |
| 1983-1984 | A/Brazil/11/78(H1N1)-like virus | A/Philippines/2/82 (H3N2)-like virus | B/Singapore/222/79-like virus | N/A |
| 1984-1985 | A/Chile/1/83(H1N1)-like virus | A/Philippines/2/82 (H3N2)-like virus | B/USSR/100/83-like virus | N/A |
| 1985-1986 | A/Chile/1/83(H1N1)-like virus | A/Philippines/2/82 (H3N2)-like virus | B/USSR/100/83-like virus | N/A |
| 1986-1987 | A/Chile/1/83(H1N1)-like virus | A/Christchurch/4/1985 (H3N2)-like virus and A/Mississippi/1/85 (H3N2)-like virus | B/Ann Arbor/1/86-like virus | N/A |
| 1987-1988 | A/Singapore/6/1986 (H1N1)-like virus | A/Leningrad/360/1986 (H3N2)-like strain | N/A | N/A |
| 1988-1989 | A/Singapore/6/1986 (H1N1)-like virus | A/Sichuan/02/87(H3N2)-like virus | B/Beijing/1/87-like rivus | N/A |
| 1989-1990 | A/Singapore/6/1986 (H1N1)-like virus | A/Shanghai/11/87(H3N2)-like virus | B/Yamagata/16/88-like virus | N/A |
| 1990-1991 | A/Singapore/6/1986 (H1N1)-like virus | A/Guizhou/54/89(H3N2)-like virus | B/Yamagata/16/88-like virus | N/A |
| 1991-1992 | A/Singapore/6/1986 (H1N1)-like virus | A/Beijing/353/89(H3N2)-like virus | B/Yamagata/16/88-like virus | N/A |
| 1992-1993 | N/A | A/Beijing/353/89(H3N2)-like virus | B/Yamagata/16/88-like virus | N/A |
| 1993-1994 | A/Singapore/6/1986 (H1N1)-like virus | A/Beijing/32/92(H3N2)-like virus | B/Panama/45/90-like virus | N/A |
| 1994-1995 | A/Singapore/6/1986 (H1N1)-like virus | A/Shangdong/9/93 (H3N2)-like virus | B/Panama/45/90-like virus | N/A |
| 1995-1996 | A/Singapore/6/1986 (H1N1)-like virus | A/Johannesburg/33/94(H3N2)-like virus | B/Beijing/184/93-like virus | N/A |
| 1996-1997 | A/Singapore/6/1986 (H1N1)-like virus | A/Wuhan/359/95(H3N2)-like virus | B/Beijing/184/93-like virus | N/A |
| 1997-1998 | A/Bayern/7/95(H1N1)-like virus | A/Wuhan/359/95 (H3N2)-like virus | B/Beijing/184/93-like virus | N/A |

TABLE 3

Influenza vaccine components by year-Southern Hemisphere

| Southern Hemisphere | H1N1 | H3N2 | B-strain | additional B-strain for QIV |
|---|---|---|---|---|
| 1975 | N/A | A/Port Chalmers/1/1973(H3N2)-like virus | B/HongKong/05/1972-like virus | N/A |
| 1976 | A/Scotland/840/74-like virus (H1N1) | A/Port Chalmers/1/1973(H3N2)-like virus | B/HongKong/05/1972-like virus | N/A |
| 1977 | N/A | A/Victoria/3/75(H3N2)-like virus | B/HongKong/05/1972-like virus | N/A |
| 1978 | N/A | A/Victoria/3/75(H3N2)-like virus | B/HongKong/05/1972-like virus | N/A |
| 1979 | A/USSR/90/77(H1N1)-like virus | A/Texas/1/77(H3N2)-like virus | B/HongKong/05/1972-like virus | N/A |
| 1980 | A/USSR/90/77(H1N1)-like virus | A/Texas/1/77(H3N2)-like virus | N/A | N/A |
| 1981 | A/Brazil/11/78(H1N1)-like virus | A/Bangkok/01/1979 (H3N2)-like virus | B/Singapore/222/79-like virus | N/A |
| 1982 | A/Brazil/11/78(H1N1)-like virus | A/Bangkok/01/1979 (H3N2)-like virus | B/Singapore/222/79-like virus | N/A |
| 1983 | A/Brazil/11/78(H1N1)-like virus | A/Bangkok/01/1979 (H3N2)-like virus | B/Singapore/222/79-like virus | N/A |
| 1984 | A/Brazil/11/78(H1N1)-like virus | A/Philippines/2/82 (H3N2)-like virus | B/Singapore/222/79-like virus | N/A |
| 1985 | A/Chile/1/83(H1N1)-like virus | A/Philippines/2/82 (H3N2)-like virus | B/USSR/100/83-like virus | N/A |
| 1986 | A/Chile/1/83(H1N1)-like virus | A/Philippines/2/82 (H3N2)-like virus | B/USSR/100/83-like virus | N/A |
| 1987 | A/Chile/1/83(H1N1)-like virus | A/Christchurch/4/1985 (H3N2)-like virus and A/Mississippi/1/85 (H3N2)-like virus | B/Ann Arbor/1/86-like virus | N/A |
| 1988 | A/Singapore/6/1986 (H1N1)-like virus | A/Leningrad/360/1986 (H3N2)-like virus | N/A | N/A |
| 1989 | A/Singapore/6/1986 (H1N1)-like virus | A/Sichuan/02/87(H3N2)-like virus | B/Beijing/1/87-like virus | N/A |
| 1990 | A/Singapore/6/1986 (H1N1)-like virus | A/Shanghai/11/87(H3N2)-like virus | B/Yamagata/16/88-like virus | N/A |
| 1991 | A/Singapore/6/1986 (H1N1)-like virus | A/Guizhou/54/89(H3N2)-like virus | B/Yamagata/16/88-like virus | N/A |
| 1992 | A/Singapore/6/1986 (H1N1)-like virus | A/Beijing/353/89(H3N2)-like virus | B/Yamagata/16/88-like virus | N/A |
| 1993 | A/Singapore/6/1986 (H1N1)-like virus | A/Beijing/353/89(H3N2)-like virus | B/Yamagata/16/88-like virus | N/A |
| 1994 | A/Singapore/6/1986 (H1N1)-like virus | A/Beijing/32/92(H3N2)-like virus | B/Panama/45/90-like virus | N/A |
| 1995 | A/Singapore/6/1986 (H1N1)-like virus | A/Shangdong/9/93 (H3N2)-like virus | B/Panama/45/90-like virus | N/A |
| 1996 | A/Singapore/6/1986 (H1N1)-like virus | A/Johannesburg/33/94(H3N2)-like virus | B/Beijing/184/93-like virus | N/A |
| 1997 | A/Singapore/6/1986 (H1N1)-like virus | A/Wuhan/359/95(H3N2)-like virus | B/Beijing/184/93-like strain | N/A |
| 1998 | A/Bayern/7/95(H1N1)-like virus | A/Wuhan/359/95(H3N2)-like virus | B/Beijing/184/93-like virus | N/A |
| 1999 | A/Beijing/262/95(H1N1)-like virus | A/Sydney/5/97(H3N2)-like virus | B/Beijing/184/93-like virus | N/A |

TABLE 4

Influenza Vaccine components by year-Northern Hemisphere

| Northern hemisphere | H1N1 | H3N2 | B-strain | additional B-strain for QIV |
|---|---|---|---|---|
| November 1998-April 1999 | A/Beijing/262/95(H1N1)-like virus | A/Sydney/5/97(H3N2)-like virus | B/Beijing/184/93-like virus | N/A |
| November 1999-April 2000 | A/Beijing/262/95 (H1N1)-like virus | A/Sydney/5/97 (H3N2)-like virus | B/Beijing/184/93-like virus or B/Shangdong/7/97-like virus | N/A |

TABLE 4-continued

Influenza Vaccine components by year-Northern Hemisphere

| Northern hemisphere | H1N1 | H3N2 | B-strain | additional B-strain for QIV |
|---|---|---|---|---|
| 2000-2001 | A/New Caledonia/20/99 (H1N1)-like virus | A/Moscow/10/99 (H3N2)-like virus | B/Beijing/184/93-like virus | N/A |
| 2001-2002 | A/New Caledonia/20/99(H1N1)-like virus | A/Moscow/10/99(H3N2)-like virus | B/Sichuan/379/99-like virus | N/A |
| 2002-2003 | A/New Caledonia/20/99(H1N1)-like virus | A/Moscow/10/99(H3N2)-like virus | B/Hong Kong/330/2001-like virus | N/A |
| 2003-2004 | A/New Caledonia/20/99(H1N1)-like virus | A/Moscow/10/99(H3N2)-like virus | B/Hong Kong/330/2001-like virus | N/A |
| 2004-2005 | A/New Caledonia/20/99(H1N1)-like virus | A/Fujian/411/2002 (H3N2)-like virus | B/Shanghai/361/2002-like virus | N/A |
| 2005-2006 | A/New Caledonia/20/99(H1N1)-like virus | A/California/7/2004 (H3N2)-like virus | B/Shanghai/361/2002-like virus | N/A |
| 2006-2007 | A/New Caledonia/20/99(H1N1)-like | A/Wisconsin/67/2005 (H3N2)-like virus | B/Malaysia/2506/2004-like virus | N/A |
| 2007-2008 | A/Solomon Islands/3/2006 (H1N1)-like virus | A/Wisconsin/67/2005 (H3N2)-like virus | B/Malaysia/2506/2004-like virus | N/A |
| 2008-2009 | A/Brisbane/59/2007 (H1N1)-like virus | A/Brisbane/10/2007 (H3N2)-like virus | B/Florida/4/2006-like virus | N/A |
| 2009-2010 | A/Brisbane/59/2007 (H1N1)-like virus | A/Brisbane/10/2007 (H3N2)-like virus | B/Brisbane/60/2008-like virus | N/A |
| 2010-2011 | A/California/7/2009 (H1N1)-like virus | A/Perth/16/2009 (H3N2)-like virus | B/Brisbane/60/2008-like virus | N/A |
| 2011-2012 | A/California/7/2009 (H1N1)-like virus | A/Perth/16/2009 (H3N2)-like virus | B/Brisbane/60/2008-like virus | N/A |
| 2012-2013 | A/California/7/2009 (H1N1)pdm09-like virus | A/Victoria/361/2011 (H3N2)-like virus | B/Wisconsin/1/2010-like virus | B/Brisbane/60/2008-like virus |
| 2013-2014 | A/California/7/2009 (H1N1)pdm09 like virus | A(H3N2) virus antigenically like the cell-propagated prototype virus A/Victoria/361/2011 | B/Massachusetts/2/2012-like virus | B/Brisbane/60/2008-like virus |
| 2014-2015 | A/California/7/2009 (H1N1)pdm09-like virus | A/Texas/50/2012 (H3N2)-like virus | B/Massachusetts/2/2012-like virus | B/Brisbane/60/2008-like virus |

TABLE 5

Influenza Vaccine components by year-Southern Hemisphere

| Southern hemisphere | H1N1 | H3N2 | B-strain | additional B-strain for QIV |
|---|---|---|---|---|
| 1999 | A/Beijing/262/95(H1N1)-like virus | A/Sydney/5/97(H3N2)-like virus | B/Beijing/184/93-like virus | N/A |
| May-October 2000 | A/New Caledonia/20/99 (H1N1)-like virus | A/Moscow/10/99 (H3N2)-like virus | B/Beijing/184/93-like virus or B/Shangdong/7/97-like virus | N/A |
| May-October 2001 | A/New Caledonia/20/99 (H1N1)-like virus | A/Moscow/10/99 (H3N2)-like virus | B/Sichuan/379/99-like virus | N/A |
| 2002 | A/New Caledonia/20/99(H1N1)-like virus | A/Moscow/10/99(H3N2)-like virus | B/Sichuan/379/99-like virus | N/A |
| 2003 | A/New Caledonia/20/99(H1N1)-like virus | A/Moscow/10/99(H3N2)-like virus | B/Hong Kong/330/2001-like virus | N/A |

TABLE 5-continued

Influenza Vaccine components by year-Southern Hemisphere

| Southern hemisphere | H1N1 | H3N2 | B-strain | additional B-strain for QIV |
|---|---|---|---|---|
| 2004 | A/New Caledonia/20/99(H1N1)-like virus | A/Fujian/411/2002 (H3N2)-like virus | B/Hong Kong/330/2001-like virus | N/A |
| 2005 | A/New Caledonia/20/99(H1N1)-like virus | A/Wellington/1/2004 (H3N2)-like virus | B/Shanghai/361/2002-like virus | N/A |
| 2006 | A/New Caledonia/20/99(H1N1)-like virus | A/California/7/2004 (H3N2)-like virus | B/Malaysia/2506/2004-like virus | N/A |
| 2007 | A/New Caledonia/20/99(H1N1)-like | A/Wisconsin/67/2005 (H3N2)-like virus | B/Malaysia/2506/2004-like virus | N/A |
| 2008 | A/Solomon Islands/3/2006 (H1N1)-like virus | A/Brisbane/10/2007 (H3N2)-like virus | B/Florida/4/2006-like virus | N/A |
| 2009 | A/Brisbane/59/2007 (H1N1)-like virus | A/Brisbane/10/2007 (H3N2)-like virus | B/Florida/4/2006-like virus | N/A |
| 2010 | A/California/7/2009 (H1N1)-like virus | A/Perth/16/2009 (H3N2)-like virus | B/Brisbane/60/2008-like virus | N/A |
| 2011 | A/California/7/2009 (H1N1)-like virus | A/Perth/16/2009 (H3N2)-like virus | B/Brisbane/60/2008-like virus | N/A |
| 2013 | A/California/7/2009 (H1N1)pdm09 like virus | A/Perth/16/2009 (H3N2)-like virus | B/Brisbane/60/2008-like virus | N/A |
| 2013 | A/California/7/2009 (H1N1)pdm09-like virus | A/Victoria/361/2011 (H3N2)-like virus | B/Wisconsin/1/2010-like virus | B/Brisbane/60/2008-like virus |
| 2014 | A/California/7/2009 (H1N1)pdm09-like virus | A/Texas/50/2012 (H3N2)-like virus | B/Massachusetts/2/2012-like virus | B/Brisbane/60/2008-like virus |

Influenza Antigens

In some embodiments, the NAV polnynucleotides may encode one or more polypeptides of an influenza strain as an antigen. Such antigens include, but are not limited to those antigens encoded by the polynucleotides listed in Tables 6-18. In the table, the GenBank Accession Number represents either the complete or partial CDS of the encoded antigen. The NAV polynucleotides may comprise a region of any of the sequences listed in the tables or entire coding region of the mRNA listed. They may comprise hybrid or chimeric regions, or mimics or variants.

Any of the strains referred to in Tables 6-14 may also be used in an antigenic memory booster vaccine as described herein.

Lengthy table referenced here

US09872900-20180123-T00001

Please refer to the end of the specification for access instructions.

Lengthy table referenced here

US09872900-20180123-T00002

Please refer to the end of the specification for access instructions.

Lengthy table referenced here

US09872900-20180123-T00003

Please refer to the end of the specification for access instructions.

Lengthy table referenced here

US09872900-20180123-T00004

Please refer to the end of the specification for access instructions.

Lengthy table referenced here

US09872900-20180123-T00005

Please refer to the end of the specification for access instructions.

Lengthy table referenced here

US09872900-20180123-T00006

Please refer to the end of the specification for access instructions.

Lengthy table referenced here
US09872900-20180123-T00007

Please refer to the end of the specification for access instructions.

Lengthy table referenced here
US09872900-20180123-T00008

Please refer to the end of the specification for access instructions.

Lengthy table referenced here
US09872900-20180123-T00009

Please refer to the end of the specification for access instructions.

Lengthy table referenced here
US09872900-20180123-T00010

Please refer to the end of the specification for access instructions.

Lengthy table referenced here
US09872900-20180123-T00011

Please refer to the end of the specification for access instructions.

Lengthy table referenced here
US09872900-20180123-T00012

Please refer to the end of the specification for access instructions.

Lengthy table referenced here
US09872900-20180123-T00013

Please refer to the end of the specification for access instructions.

Figures 22, 23, 24, 25, 26, 27, 28, 29, 30, 31, 32:
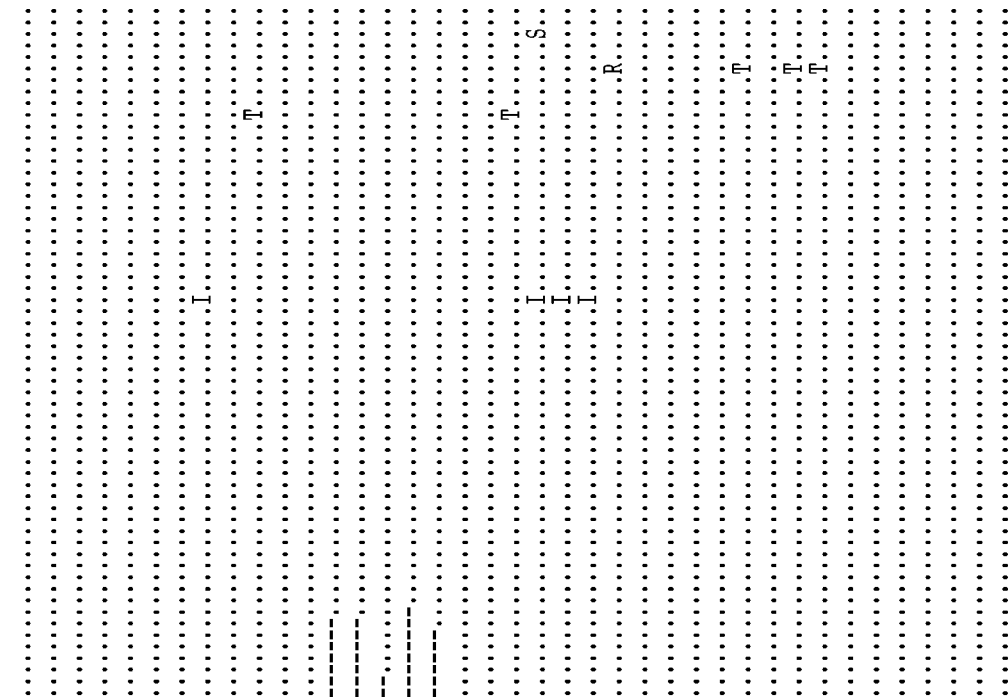

An alignment of amino acid sequences of hemagglutinin proteins from influenza A H7N9 strains are shown relative to a consensus sequence in FIG. 22. An alignment of amino acid sequences of hemagglutinin proteins from influenza A H10N8 strains are shown relative to a consensus sequence in FIG. 23.

Aspects of the present disclosure provide RNA polynucleotides encoding an influenza hemagglutinin protein or a fragment thereof. The terms "hemagglutinin," "hemagglutinin protein," and "HA" may be used interchangeably throughout and refer to a hemagglutinin protein that may be present on the surface of an influenza virus. On the viral surface, the hemagglutinin protein is present in homotrimers, each monomer of which is comprised of two subunits, HA1 and HA2, linked by a disulfide bond. Structurally, hemagglutinin proteins are comprised of several domains: a globular head domain, a stalk domain (also referred to as a stem domain), a transmembrane domain, and a cytoplasmic domain. It is generally though that during infection of a host cell (e.g., a eukaryotic cell such as a human cell) with an influenza virus, the hemagglutinin protein recognizes and binds to sialic acid of a receptor on the surface of a host cell facilitating attachment of the virus to the host cell (Gamblin et al., 2004; Ha et al., 2000). Following endocytosis of the virus and acidification of the endosome, the hemagglutinin protein undergoes a pH-dependent conformational change that allows for the hemagglutinin protein to facilitate fusion of the viral envelope with the endosome membrane of host cell and entry of the viral nucleic acid into the host cell.

In general, influenza viruses are classified based on the amino acid sequence of the viral hemagglutinin protein and/or the amino acid sequence of the viral neuraminidase (NA). In some embodiments, the hemagglutinin is of the subtype H1, H2, H3, H4, H5, H6, H7, H8, H9, H10, H11, H12, H13, H14, H15, H16, H17, or H18. The differences in amino acid sequences between hemagglutinin proteins of different subtypes are largely found within the sequence of the head domain of the protein. The amino acid sequence of the stalk domain is considered to be more conserved between hemagglutinin subtypes compared to sequence of the head domain. Domains of the hemagglutinin protein may be predicted using conventional methods known in the art.

Many naturally occurring and experimentally derived antibodies that bind and neutralize the hemagglutinin protein are thought to bind epitopes within the head domain of hemagglutinin and prevent or reduce interaction of hemagglutinin with sialic acid on receptors of host cells, thereby preventing or reducing infection of the cell. Alternatively or in addition, neutralizing antibodies may prevent or reduce fusion of the virus membrane with the membrane of the endosome. Such antibodies may bind epitopes within the stalk domain, thereby inhibiting the conformations change of the protein.

In some embodiments, the RNA polynucleotides described herein encode a fragment of a hemagglutinin protein, such as a truncated hemagglutinin protein. In some embodiments, the fragment is a headless hemagglutinin, meaning the fragment does not comprise the head domain. In some embodiments, the fragment comprises a portion of the head domain. In some embodiments, the fragment is a stalk fragment (see, e.g., Mallajosyula et al. *PNAS* (2014) E2514-E2523). In some embodiments, fragment does not comprise the cytoplasmic domain. In some embodiments, the fragment does not comprise the transmembrane domain. In such embodiments, the fragment may be referred to as a soluble or secreted hemagglutinin protein or fragment.

In some embodiments, the RNA polypeptide encodes a hemagglutinin protein or fragment thereof that is at least 90% (e.g., 91%, 92%, 93%, 94%, 95%, 96%, 97%, 98%, or 99%) identical to a hemagglutinin protein provided by an amino acid sequence in Table 14-16. The terms "identical" or percent "identity" in the context of two or more polypeptide sequences refer to two or more sequences that are the same. The percent identity between polypeptide sequences may be performed using algorithms known in the art, such as BLAST and CLUSTAL.

The sequence of the hemagglutinin protein or fragment thereof may be obtained from any source. In some embodiments, the sequence of the hemagglutinin protein or fragment thereof is from an avian influenza strain. In some embodiments, the sequence of the hemagglutinin protein or fragment thereof is from an avian influenza strain that is capable of or at risk of infecting human subjects. In some embodiments, the sequence of the hemagglutinin protein or fragment thereof is from a porcine influenza strain. In some embodiments, the sequence of the hemagglutinin protein or fragment thereof is from a porcine influenza strain that is capable of or at risk of infecting human subjects.

In any of the embodiments described herein, the sequence of the hemagglutinin or fragment thereof may be modified or optimized (such as codon optimized) for expression in a particular cell or host organism.

Methicillin-Resistant *Staphylococcus aureus* (MRSA)

MRSA is the most common invasive bacterial infection with an incidence of 20-100 per 100,000 persons. It is responsible for ~20,000 deaths in US alone Risk factors for MRSA include healthcare exposure, antibiotic use, and HIV. It is a common complication of joint replacement surgery which then requires removal and replacement of the joint. Symptoms include pneumonia, skin and soft-tissue infections, osteomyelitis (e.g., prostheses), endocarditis, bacteremia and sepsis.

Current treatment includes intravenous anti-staphylococcal antibiotics (e.g., Vancomycin, Zyvox, Cubicin), contact precautions, and management of sepsis (Goal-directed therapy +/− ICU admission).

The MRSA HA pathogens have multiple antigens so a combinatorial approach is an important principle to combat multi-drug resistance. Cell culture limits number of antigens in traditionally-produced vaccines making the present NAV approach superior.

MRSA antigens may include but not limited to NDM1, mecA, all b-lactamases (antibiotic resistance); Protein A mutant (immune escape); SDRD/SDRE (adherence); IsdA or IsdB (Lactoferrin excape, Fe transport); TSST, a-HL, and PVL(toxins).

In one embodiment, the NAVs of the present invention may comprise a multivalent vaccine, e.g., comprising a polynucleotide which encodes at least two MRSA antigens, including but not limited to NDM-1 and SpAmut.

In one embodiment, the SpA antigen or loss of function mutant SpAKKAA of MRSA is encoded by a polynucleotide of a NAV. Kim et al. (J. Exp. Med. Vol. 207 No. 9; 1863-1870; the contents of which are herein incorporated by reference in its entirety) describes that the mutation of the staphylococcal protein A (SpA) at five Ig-binding domains resulted in variant SpAKKAA which cannot bind to Fcγ or Fab V$_H$3 and promote cell apoptosis. Immunization of mice with SpAKKAA raised antibodies was found to protect mice against challenge with highly virulent MRSA strains and even enabled MRSA-challenged mice to mount antibody responses to different staphylococcal antigens. Falugi et al. (mBio 4(5):e00575-13. doi:10.1128/mBio.00575-13; the contents of which are herein incorporated by reference in its entirety) found that the SpAKKAA mutant elicited B cell responses to key virulence antigens that protected animals against a lethal *S. aureus* challenge and the SpAKKAA mutant was able to elicit an adaptive response that protected against recurrent infection. Schineewind et al. describes a SpA antigen or loss of function mutant of SpA in International Patent Publication Nos. WO2011127032, WO2011005341, WO2012003474, WO2012034067 and WO2013025834 and US Patent Publication Nos. US20130136746, US20120114686, US20130171183 and US20130230550, the contents of each of which are herein incorporated by reference in their entirety. As a non-limiting example, the SpA mutant may comprise at least one substitution in the amino acid sequence that disrupts the Fc binding and at least one substitution in the amino acid sequence that disrupts the VH3 binding (see e.g., International Publication No. WO2011005341 and US Patent publication No. US20120114686, the contents of each of which are herein incorporated by reference in its entirety). As another non-limiting example, the SpA mutant may comprise a substitution in the D domain of a SpA sequence at positions 9, 10, 36 and 37 of the SpA sequence (see e.g., International Patent Publication Nos. WO2011127032, WO2012003474 and WO2012034067 and US Patent Publication Nos. US20130136746, US20130171183 and US20130230550, the contents of each of which are herein incorporated by reference in their entirety). The amino acids at positions 9 and 10 may be substituted for glycine and the amino acids at positions 36 and 37 may be substituted for serine (see e.g., International Patent Publication Nos. WO2011127032 and WO2012003474 and US Patent Publication Nos. US20130136746 and US20130171183, the contents of each of which are herein incorporated by reference in their entirety). As yet another non-limiting example, the SpA mutant may comprise a substitution at position 9, 10, 36 and 37 of SEQ ID NO: 2 described in International Patent Publication Nos. WO2011127032 and WO2012003474 and US Patent Publication Nos. US20130136746 and US20130171183, the contents of each of which are herein incorporated by reference in their entirety.

SpA-binding to B-cell surface V(H)3 leads to B-cell receptor crosslinking followed by B-cell apoptosis, clonal B-cell deletion and block of affinity maturation and B-cell memory. SpA-binding to Fcg at the FcR-binding site of secreted antibodies inhibits activation of effector cells critical for bacterial clearance and adaptive immunity.

SpAKKAA is a loss-of-function mutant of SpA without a functional Fcg and V(H)3 binding site.

Vaccination with SpAKKAA allows clonal B-cell expansion and sufficient time for antibody affinity maturation leading to B-cell clones with higher affinity to SpA epitopes than Fcg or V(H)3 binding of SpA. This enables antibody binding to SpA through affinity-matured CDRs with Fc portions freely available for effector cell activation and B-cell memory creation.

Thus, SpAKKAA immunization enable MRSA-challenged subjects to mount antibody responses to many different staphylococcal antigens.

In one embodiment, the NAV is a multi-valent vaccine with SpAKKAA as the center antigen. This provides a key advantage over inactivated, whole MRSA vaccines currently in clinical development.

In one embodiment, the MRSA NAVs are used to target at risk populations such as those having linezolid-resistant joint/bone infections; chronic disease; healthcare workers and to prevent outbreak of resistant strains.

MRSA toxins such as PVL, a-HL, TSST-1 may be encoded by the NAVs of the invention. Alternatively, any of the beta-lactamase genes may be targeted in a manner which reduces their ability to protect the bacteria thereby rendering it more susceptible to traditional antibiotic attack. Such targeting of the lactamase enzymes may be personalized to a particular subject where a sample is obtained and the unique lactamase sequence is determined through standard techniques in the art. Inhibitors of the unique lactamase sequence can then be designed creating a personalized medicine or vaccine.

Dengue

Dengue fever is a mosquito-borne virus and is epidemic (SE Asia) and endemic (Sub-Saharan Africa, India). As much as 40% of world's population is at risk with over 100 million infections per year according to the World Health Organiztion. There have been about 1-2 million clinically documented cases. The mortality rate depends on access to healthcare and can reach as high as 20%.

Symptoms include acute onset fevers with terrible joint and muscle pain for 5-7 days, followed by weeks of lethargy and fatigue. Dehydration and hemorrhage are the main drivers of mortality, hence need for access to IV fluids to avoid shock. Supportive care includes fluid resuscitation but prevention is the primary means of limiting the impact of virus (e.g., mosquito control, personal protection).

For Dengue fever, disease characteristics requires a neutralizing—but not enhancing—antibody response to the four most critical Dengue serotypes (DENV1-4). Therefore a multivalent antigen targeting key proteins/protein domains of four serotypes of Dengue virus (DENV 1-4) would have value as a vaccine.

In one embodiment, NAVs of the invention comprise one or more polynucleotides which encode the E protein domain III (DENV1-4 tandem mRNA), the E protein domain I/II hinge region (DENV1-4 individual mRNAs), the prM protein (DENV1-4 tandem or individual mRNAs) and the C protein (DENV1-4 tandem or single mRNAs).

In one embodiment, the most potent NAV vaccine is selected by measuring the antibody titer in Balb/c mice followed by tests of selected vaccines in Dengue disease models. Upon rescue in disease model, crossreactivity analysis in in-vitro viral assays to ensure activity of multivalent vaccine against all serotypes is performed.

In some embodiments cross-neutralizing Ab-titers agains each of the four Dengue strains (DENV1-4) in a virus neutralization assay are tested either in vitro or in vivo as in (BMC Microbiol. 2014; 14: 44; and Immunology. 2012 July; 136 (3):334-43), the contents of which are incorporated herein by reference.

In some embodiments, neutralizing vs enhancing Ab-titers is evaluated and in another embodiment the RNAVare tested in humanized mouse model for Dengue disease (J Virol. 2014 February; 88(4):2205-18, thencontents of which are incorporated herein by reference in their entirety).

The NAV targeting Dengue is referred to as a multi-genotype antigen NAV.

Enterotoxic *E. Coli* (ETEC)

ETEC is the most common cause of diarrhea in the developing world with between 300 k-500 k deaths per year. Transmission is via fecal-oral transmission (water, food). Sympoms include secretory diarrhea (mediated by two toxins: heat-stable and heat-labile), abdominal pain and cramping, nausea and vomiting. Generally symptoms last less than 1 week, and rarely greater than 2 weeks. The resultant dehydration is the primary cause of more serious sequelae. Currently supportive care and fluid resuscitation are the treatment where generally an uncomplicated infection resolves on its own.

Previous ETEC vaccines were based on a single antigen or had a sole focus on toxin neutralization that was not effective in providing long-lasting immunity.

According to the present invention three pathways are addressed by the selected antigens in a multivalent approach: (1) Toxins: Sta3 and eltA/eltB; (2) Adhesion proteins critical for delivery of toxins to the endothelium: EatA, etpA, and etpB; and (3) Proteins enabling colonialization: cssA.

The ETEC NAV of the present invention is designed to enable long-term protection against ETEC. And even to provide prophylactic treatement such as for travelers.

*Clostridium Difficile*

*C. difficile* causes an increasingly common diarrheal illness associated with key risk factors including exposure to a healthcare setting (e.g., hospitalization, nursing home residence), and antibiotics (esp. amoxicillin, clindamycin).

Symptoms include recurrent diarrhea and Pseduomembranous colitis. Current treatment includes diagnostics with toxin and reflex antigen and/or treatment with metronidazole and vanocmycin.

The present invention provides a trivalent antigen approach to the treatment of *C. difficile* infection. The antigens encoded include toxin A (enterotoxin; CD Toxin A 136754); toxin b (cytotoxin; CD Toxin B 136755), and binary toxin (cdtB; CD cdtB 136757).

In some embodiments, the multivalent NAV prevents C. *Difficile* infection among patients: (1) receiving certain medications (antibiotics, PPIs) or (2) with healthcare exposure (hospitalized, nursing home etc) in a manner which blocks the effects of the organisms' toxin and key virulence factors.

Tuberculosis

Tuberculosis is an infectious disease caused by various strains of mycobacteria, usually *Mycobacterium tuberculosis*. Symptoms include a chronic cough with blood-tinged sputum, fever, night sweats, and weight loss.

The current challenges for the development of a vaccine against TB are (i) three different disease states requiring a different set of antigens: pre-infection (prophylactic vaccine), latent infection (therapeutic vaccine) and active infection (therapeutic vaccine); and (ii) different set of adjuvants critical to induce a protective while not overshooting immune response; and (iii) an unclear understanding on the necessary immune response to clear the infection.

Therefore it will be required to combine different sets of cytokines as an adjuvant with a different set of antigens dependent on the disease state. The following cytokines provide a potential adjuvant arm of the vaccine: GM-CSF, IL-17, IFNg, IL-15, IL-2, IL-21, Anti-PD1/2, lactoferrin. The following antigens represent a non-exhaustive list: Ag85A (Rv3804c), Ag85B (Rv1886c), TB10.4 (Rv0288), ESAT6(Rv3785), Rv2660L, Rv3619, Rv1813c, Rv3620c, Rv2608, Rv1196, Rv0125, and MT401.

Middle-East Respiratory Syndrome Coronavirus (MERS-CoV)

MERS-CoV, previously known as the Novel Coronavirus or SARS-like virus, is a member of the coronavirus family. Symptoms are similar to SARS infections and include coughing, production of mucous, shortness of breath, malaise—a general feeling of being unwell, chest pain, fever, diarrhea (in some cases) and renal (kidney) failure. Human enterovirus 71 and Human enterovirus 68

Enterovirus 71 (EV-71) is one of the major causative agents for hand, foot and mouth disease (HFMD), and is sometimes associated with severe central nervous system diseases. The Enterovirus 71 (EV71) infection may be asymptomatic.

Enterovirus 68 (EV68, EV-D68) is a member of the Picornaviridae family, an enterovirus (a group of ssRNA viruses containing the polioviruses, coxsackieviruses, and echoviruses). First isolated in 1962, it has been been on a worldwide upswing in the last few years. It may be involved in cases of a recent outbreak of polio-like disease in California.

Antigens

Antigens of the present invention include polypeptides, peptides and/or polypeptides of interest and are encoded by the polynucleotides of the invention. Polynucleotides encoding such antigens of the invention are described in more detail below under "Design, Synthesis and Quantitation of NAV Polynucleotides".

III. Design, Synthesis and Quantification of NAV Polynucleotides

According to the present invention, the polynucleotides encode at least one polypeptide of interest, e.g., an antigen. Antigens of the present invention may be wild type (i.e., derived from the infectious agent) or modified (e.g., engineered, designed or artificial). They may have any combination of the features described herein.

The present invention provides nucleic acid molecules, specifically polynucleotides which, in some embodiments, encode one or more peptides or polypeptides of interest. Such peptides or polypeptides, according to the invention may serve as an antigen or antigenic molecule. The term "nucleic acid," in its broadest sense, includes any compound and/or substance that comprise a polymer of nucleotides. These polymers are often referred to as polynucleotides.

Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

In one embodiment, linear polynucleotides encoding one or more antigens of the NAVs of the present invention which are made using only in vitro transcription (IVT) enzymatic synthesis methods are referred to as "IVT polynucleotides."

In another embodiment, the polynucleotides of the present invention which have portions or regions which differ in size and/or chemical modification pattern, chemical modification position, chemical modification percent or chemical modification population and combinations of the foregoing are known as "chimeric polynucleotides." A "chimera" according to the present invention is an entity having two or more incongruous or heterogeneous parts or regions. As used herein a "part" or "region" of a polynucleotide is defined as any portion of the polynucleotide which is less than the entire length of the polynucleotide.

In yet another embodiment, the polynucleotides of the present invention that are circular are known as "circular polynucleotides" or "circP." As used herein, "circular polynucleotides" or "circP" means a single stranded circular polynucleotide which acts substantially like, and has the properties of, an RNA. The term "circular" is also meant to encompass any secondary or tertiary configuration of the circP.

In some embodiments, the polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

In one embodiment, the polynucleotides of the present invention may encode at least one peptide or polypeptide of interest. In another embodiment, the polynucleotides of the present invention may be non-coding.

In one embodiment, the length of a region encoding at least one peptide polypeptide of interest of the polynucleotides present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In one embodiment, the polynucleotides of the present invention is or functions as a messenger RNA (mRNA). As used herein, the term "messenger RNA" (mRNA) refers to any polynucleotide which encodes at least one peptide or polypeptide of interest and which is capable of being translated to produce the encoded peptide polypeptide of interest in vitro, in vivo, in situ or ex vivo.

In one embodiment, the polynucleotides of the present invention may be structurally modified or chemically modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCCG". Here, the dinucleotide "CC" has been inserted, resulting in a structural modification to the polynucleotide.

In one embodiment, the polynucleotides of the present invention, such as IVT polynucleotides or circular polynculeotides, may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the polynucleotides may have a uniform chemical modification of two, three, or four of the same nucleoside type throughout the entire polynucleotide (such as all uridines and all cytosines, etc. are modified in the same way).

When the polynucleotides of the present invention are chemically and/or structurally modified the polynucleotides may be referred to as "modified polynucleotides."

In one embodiment, the polynucleotides of the present invention may include a sequence encoding a self-cleaving peptide. The self-cleaving peptide may be, but is not limited to, a 2A peptide. As a non-limiting example, the 2A peptide may have the protein sequence: GSGATNFSLLKQAGD-VEENPGP (SEQ ID NO: 963), fragments or variants thereof. In one embodiment, the 2A peptide cleaves between the last glycine and last proline. As another non-limiting example, the polynucleotides of the present invention may include a polynucleotide sequence encoding the 2A peptide having the protein sequence GSGATNFSLLKQAGD-VEENPGP (SEQ ID NO: 963) fragments or variants thereof.

One such polynucleotide sequence encoding the 2A peptide is GGAAGCGGAGCTACTAACTTCAGCCTGCT-GAAGCAGGCTGGAGACGTGGA GGAGAACCCTG-GACCT (SEQ ID NO: 964). The polynucleotide sequence of the 2A peptide may be modified or codon optimized by the methods described herein and/or are known in the art.

In one embodiment, this sequence may be used to separate the coding region of two or more polypeptides of interest. As a non-limiting example, the sequence encoding the 2A peptide may be between a first coding region A and a second coding region B (A-2Apep-B). The presence of the 2A peptide would result in the cleavage of one long protein into protein A, protein B and the 2A peptide. Protein A and protein B may be the same or different peptides or polypeptides of interest. In another embodiment, the 2A peptide may be used in the polynucleotides of the present invention to produce two, three, four, five, six, seven, eight, nine, ten or more proteins.

Polynucleotide Architecture

Traditionally, the basic components of an mRNA molecule include at least a coding region, a 5'UTR, a 3'UTR, a 5' cap and a poly-A tail. The IVT polynucleotides of the present invention may function as mRNA but are distinguished from wild-type mRNA in their functional and/or structural design features which serve to overcome existing problems of effective polypeptide production using nucleic-acid based therapeutics. It is to be understood that the antigens of the NAVs of the present invention may be encoded by IVT polynucleotides, as described herein.

FIG. 1 shows a primary construct 100 of an IVT polynucleotide of the present invention. Such polynucleotides are useful in NAV compositions, RNAV compositions or mRNA vaccines. As used herein, "primary construct" refers to a polynucleotide of the present invention which encodes one or more polypeptides of interest and which retains sufficient structural and/or chemical features to allow the polypeptide of interest encoded therein to be translated.

Figure 1B:
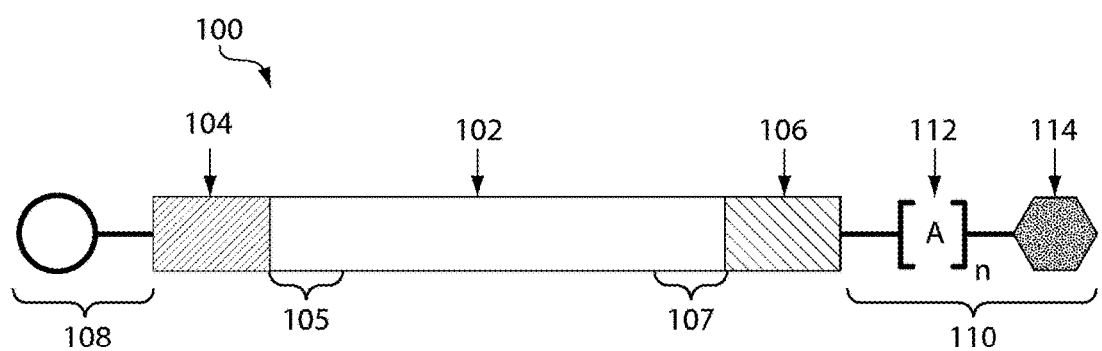

According to FIGS. 1A and 1B, the polynucleotide 100 here contains a first region of linked nucleotides 102 that is flanked by a first flanking region 104 and a second flaking region 106. The polypeptide of interest may comprise at its 5' terminus one or more signal sequences encoded by a signal sequence region 103. The flanking region 104 may comprise a region of linked nucleotides comprising one or more complete or incomplete 5' UTRs sequences which may be completely codon optimized or partially codon optimized. The flanking region 104 may include at least one nucleic acid sequence including, but not limited to, miR sequences, TERZAK™ sequences and translation control sequences. The flanking region 104 may also comprise a 5' terminal cap 108. The 5' terminal capping region 108 may include a naturally occurring cap, a synthetic cap or an optimized cap. Non-limiting examples of optimized caps include the caps taught by Rhoads in U.S. Pat. No. 7,074,596 and International Patent Publication No. WO2008157668, WO2009149253 and WO2013103659, the contents of each of which are herein incorporated by reference in its entirety. The second flanking region 106 may comprise a region of linked nucleotides comprising one or more complete or incomplete 3' UTRs. The second flanking region 106 may be completely codon optimized or partially codon optimized. The flanking region 106 may include at least one nucleic acid sequence including, but not limited to, miR sequences and translation control sequences. The flanking region 106 may also comprise a 3' tailing sequence 110. The 3' tailing sequence 110 may include a synthetic tailing region 112 and/or a chain terminating nucleoside 114. Non-liming examples of a synthetic tailing region include a polyA sequence, a polyC sequence, and/or a polyA-G quartet. Non-limiting examples of chain terminating nucleosides include 2'-O methyl, F and locked nucleic acids (LNA).

Bridging the 5' terminus of the first region 102 and the first flanking region 104 is a first operational region 105. Traditionally this operational region comprises a Start codon. The operational region may alternatively comprise any translation initiation sequence or signal including a Start codon.

Bridging the 3' terminus of the first region 102 and the second flanking region 106 is a second operational region 107. Traditionally this operational region comprises a Stop codon. The operational region may alternatively comprise any translation initiation sequence or signal including a Stop codon. Multiple serial stop codons may also be used in the IVT polynucleotide. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

The shortest length of the first region of the primary construct of the IVT polynucleotide of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine. It is understood that the NAV, RNAV or mRNA vaccines of the invention may be translatable and include such first region of a primary construct.

The length of the first region of the primary construct of the IVT polynucleotide encoding the polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IVT polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, the first and second flanking regions of the IVT polynucleotide may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, the tailing sequence of the IVT polynucleotide may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides and 160 nucleotides are functional.

According to the present invention, the capping region of the IVT polynucleotide may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions of the IVT polynucleotide may range from 3 to 40, e.g., 5-30, 10-20, 15, or at least 4, or 30 or fewer nucleotides in length and may comprise, in addition to a Start and/or Stop codon, one or more signal and/or restriction sequences.

In one embodiment, the IVT polynucleotides of the present invention may be structurally modified or chemically modified. When the IVT polynucleotides of the present invention are chemically and/or structurally modified the polynucleotides may be referred to as "modified IVT polynucleotides."

In one embodiment, if the IVT polynucleotides of the present invention are chemically modified they may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the IVT polynucleotides may have a uniform chemical modification of two, three, or four of the same nucleoside type throughout the entire polynucleotide (such as all uridines and all cytosines, etc. are modified in the same way).

In one embodiment, the IVT polynucleotides of the present invention may include a sequence encoding a self-cleaving peptide, described herein, such as but not limited to the 2A peptide. The polynucleotide sequence of the 2A peptide in the IVT polynucleotide may be modified or codon optimized by the methods described herein and/or are known in the art.

In one embodiment, this sequence may be used to separate the coding region of two or more polypeptides of interest in the IVT polynucleotide.

In one embodiment, the IVT polynucleotide of the present invention may be structurally and/or chemically modified. When chemically modified and/or structurally modified the IVT polynucleotide may be referred to as a "modified IVT polynucleotide."

In one embodiment, the IVT polynucleotide may encode at least one peptide or polypeptide of interest. In another embodiment, the IVT polynucleotide may encode two or more peptides or polypeptides of interest. Non-limiting examples of peptides or polypeptides of interest include heavy and light chains of antibodies, an enzyme and its substrate, a label and its binding molecule, a second messenger and its enzyme or the components of multimeric proteins or complexes.

Chimeric Polynucleotide Architecture

The chimeric polynucleotides or RNA constructs of the present invention maintain a modular organization similar to IVT polynucleotides, but the chimeric polynucleotides comprise one or more structural and/or chemical modifications or alterations which impart useful properties to the polynucleotide. As such, the chimeric polynucleotides which are modified mRNA molecules of the present invention are termed "chimeric modified mRNA" or "chimeric mRNA."

It is to be understood that the antigens of the NAVs of the present invention may be encoded by a chimeric polynucleotide, RNA construct, chimeric modified mRNA or chimeric mRNA.

Chimeric polynucleotides have portions or regions which differ in size and/or chemical modification pattern, chemical modification position, chemical modification percent or chemical modification population and combinations of the foregoing.

Figure 2:
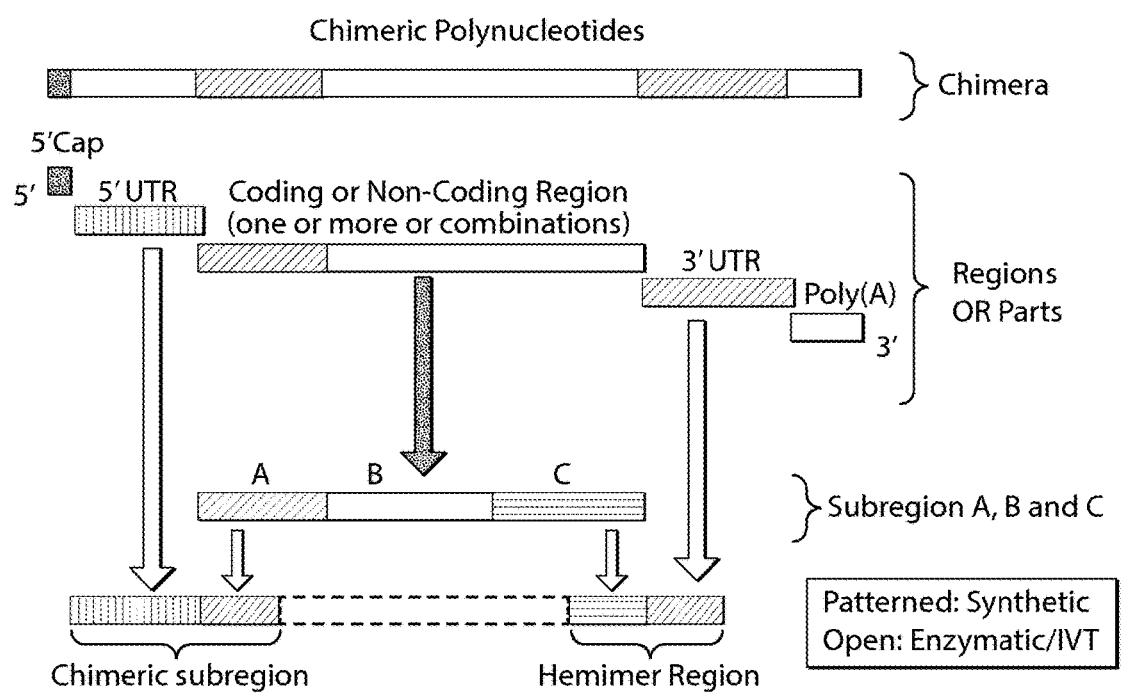
FIG. 2 is a schematic of a series of chimeric polynucleotides of the present invention.
Figure 3:
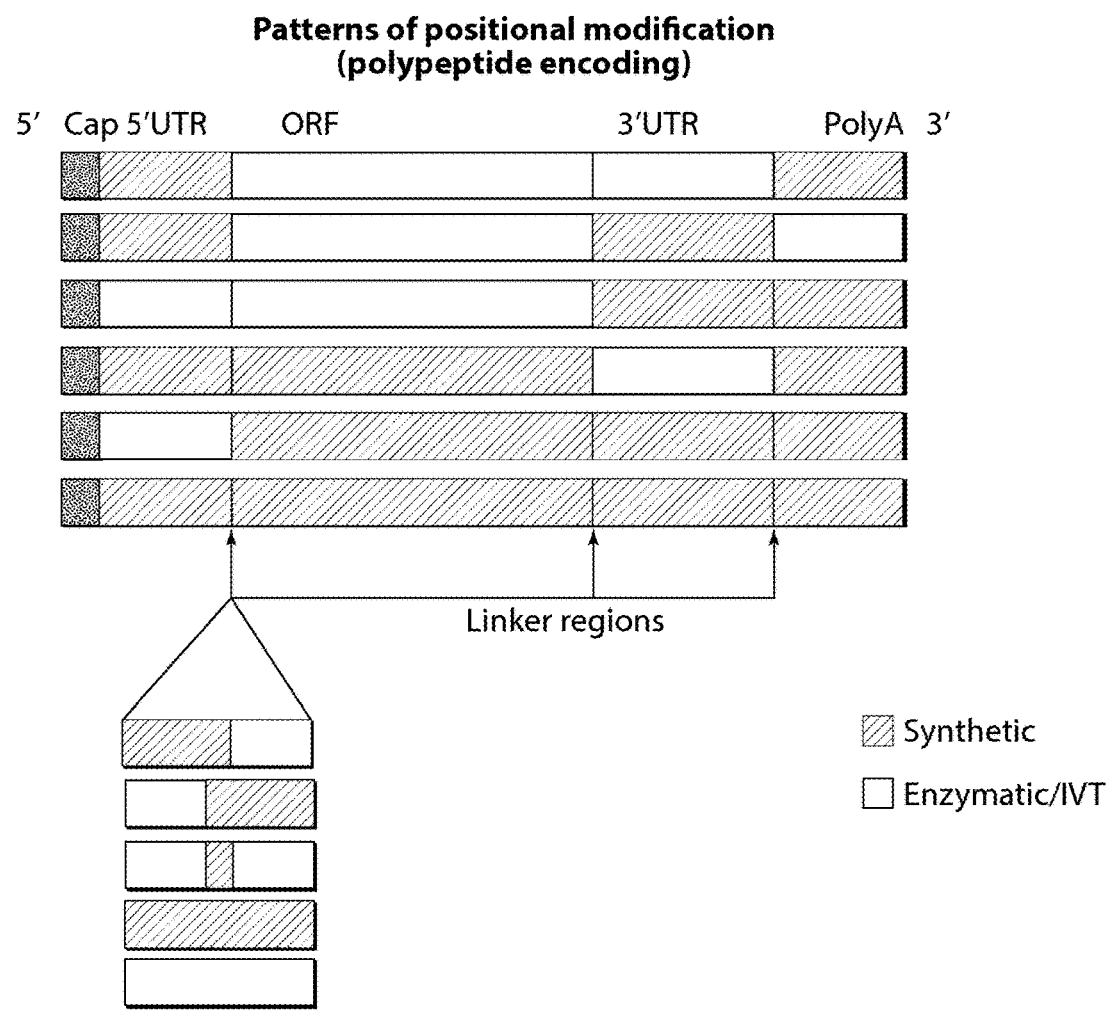
FIG. 3 is a schematic of a series of chimeric polynucleotides illustrating various patterns of positional modifications and showing regions analogous to those regions of an mRNA polynucleotide.

Examples of parts or regions, where the chimeric polynucleotide functions as an mRNA and encodes a polypeptide of interest include, but are not limited to, untranslated regions (UTRs, such as the 5' UTR or 3' UTR), coding regions, cap regions, polyA tail regions, start regions, stop regions, signal sequence regions, and combinations thereof. FIG. 2 illustrates certain embodiments of the chimeric polynucleotides of the invention which may be used as mRNA. FIG. 3 illustrates a schematic of a series of chimeric polynucleotides identifying various patterns of positional modifications and showing regions analogous to those regions of an mRNA polynucleotide. Regions or parts that join or lie between other regions may also be designed to have subregions. These are shown in the figure.

In some embodiments, the chimeric polynucleotides of the invention have a structure comprising Formula I.

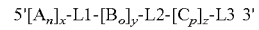  Formula I wherein:

each of A and B independently comprise a region of linked nucleosides;

C is an optional region of linked nucleosides;

at least one of regions A, B, or C is positionally modified, wherein said positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications;

n, o and p are independently an integer between 15-1000;
x and y are independently 1-20;
z is 0-5;
L1 and L2 are independently optional linker moieties, said linker moieties being either nucleic acid based or non-nucleic acid based; and
L3 is an optional conjugate or an optional linker moiety, said linker moiety being either nucleic acid based or non-nucleic acid based.

In some embodiments the chimeric polynucleotide of Formula I encodes one or more peptides or polypeptides of interest. Such encoded molecules may be encoded across two or more regions.

In another aspect, the invention features a chimeric polynucleotide encoding a polypeptide, wherein the polynucleotide has a sequence including Formula II:

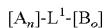
[$A_n$]-$L^1$-[$B_o$]                         Formula II wherein each A and B is independently any nucleoside;
n and o are, independently 15 to 1000; and
$L^1$ has the structure of Formula III:

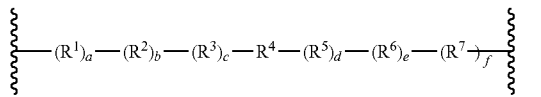
Formula III wherein a, b, c, d, e, and f are each, independently, 0 or 1;
each of $R^1$, $R^3$, $R^5$, and $R^7$, is, independently, selected from optionally substituted $C_1$-$C_6$ alkylene, optionally substituted $C_1$-$C_6$ heteroalkylene, O, S, and $NR^8$;
$R^2$ and $R^6$ are each, independently, selected from carbonyl, thiocarbonyl, sulfonyl, or phosphoryl;
$R^4$ is optionally substituted $C_1$-$C_{10}$ alkylene, optionally substituted $C_2$-$C_{10}$ alkenylene, optionally substituted $C_2$-$C_{10}$ alkynylene, optionally substituted $C_2$-$C_9$ heterocyclylene, optionally substituted $C_6$-$C_{12}$ arylene, optionally substituted $C_2$-$C_{100}$ polyethylene glycolene, or optionally substituted $C_1$-$C_{10}$ heteroalkylene, or a bond linking $(R^1)_a$—$(R^2)_b$—$(R^3)_c$ to $(R^5)_d$—$(R^6)_e$—$(R^7)_f$ wherein if c, d, e, f, g, and h are 0, $R^4$ is not a bond; and
$R^8$ is hydrogen, optionally substituted $C_1$-$C_4$ alkyl, optionally substituted $C_2$-$C_4$ alkenyl, optionally substituted $C_2$-$C_4$ alkynyl, optionally substituted $C_2$-$C_6$ heterocyclyl, optionally substituted $C_6$-$C_{12}$ aryl, or optionally substituted $C_1$-$C_7$ heteroalkyl;
wherein $L^1$ is attached to [$A_n$] and [$B_o$] at the sugar of one of the nucleosides (e.g., at the 3' position of a five-membered sugar ring or 4' position of a six membered sugar ring of a nucleoside of [$A_n$] and the 5' position of a five-membered sugar ring or 6' position of a six membered sugar ring of a nucleoside of [$B_o$] or at the 5' position of a five-membered sugar ring or 6' position of of a six membered sugar ring of a nucleoside of [$A_n$] and the 3' position of a five-membered sugar ring or 4' position of a six membered sugar ring of a nucleoside of [$B_o$]).

In some embodiments, at least one of [$A_n$] and [$B_o$] includes the structure of Formula IV:

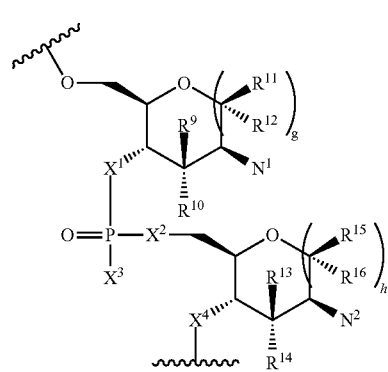
Formula IV wherein each of $N^1$ and $N^2$ is independently a nucleobase;
each of $R^9$, $R^{10}$, $R^{11}$, $R^{12}$, $R^{13}$, $R^{14}$, $R^{15}$, and $R^{16}$ is, independently, H, halo, hydroxy, thiol, optionally substituted $C_1$-$C_6$ alkyl, optionally substituted $C_1$-$C_6$ heteroalkyl, optionally substituted $C_2$-$C_6$ heteroalkenyl, optionally substituted $C_2$-$C_6$ heteroalkynyl, optionally substituted amino, azido, or optionally substituted $C_6$-$C_{10}$ aryl;
each of g and h is, independently, 0 or 1;
each $X^1$ and $X^4$ is, independently, O, NH, or S;
each $X^2$ is independently O or S; and
each $X^3$ is OH or SH, or a salt thereof.

In another aspect, the invention features a chimeric polynucleotide encoding a polypeptide, wherein the polynucleotide has a sequence including Formula II:

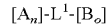
[$A_n$]-$L^1$-[$B_o$]                         Formula II wherein each A and B is independently any nucleoside;
n and o are, independently 15 to 1000; and
$L^1$ is a bond or has the structure of Formula III:

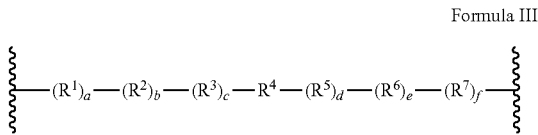
Formula III wherein a, b, c, d, e, and f are each, independently, 0 or 1;
each of $R^1$, $R^3$, $R^5$, and $R^7$, is, independently, selected from optionally substituted $C_1$-$C_6$ alkylene, optionally substituted $C_1$-$C_6$ heteroalkylene, O, S, and $NR^8$;
$R^2$ and $R^6$ are each, independently, selected from carbonyl, thiocarbonyl, sulfonyl, or phosphoryl;
$R^4$ is optionally substituted $C_1$-$C_{10}$ alkylene, optionally substituted $C_2$-$C_{10}$ alkenylene, optionally substituted $C_2$-$C_{10}$ alkynylene, optionally substituted $C_2$-$C_9$ heterocyclylene, optionally substituted $C_6$-$C_{12}$ arylene, optionally substituted $C_2$-$C_{100}$ polyethylene glycolene, or optionally substituted $C_1$-$C_{10}$ heteroalkylene, or a bond linking $(R^1)_a$—$(R^2)_b$—$(R^3)_c$ to $(R^5)_d$—$(R^6)_e$—$(R^7)_f$; and
$R^8$ is hydrogen, optionally substituted $C_1$-$C_4$ alkyl, optionally substituted $C_2$-$C_4$ alkenyl, optionally substituted $C_2$-$C_4$ alkynyl, optionally substituted $C_2$-$C_6$ heterocyclyl, optionally substituted $C_6$-$C_{12}$ aryl, or optionally substituted $C_1$-$C_7$ heteroalkyl;

wherein $L^1$ is attached to $[A_n]$ and $[B_o]$ at the sugar of one of the nucleosides (e.g., at the 3' position of a five-membered sugar ring or 4' position of a six membered sugar ring of a nucleoside of $[A_n]$ and the 5' position of a five-membered sugar ring or 6' position of of a six membered sugar ring of a nucleoside of $[B_o]$ or at the 5' position of a five-membered sugar ring or 6' position of of a six membered sugar ring of a nucleoside of $[A_n]$ and the 3' position of a five-membered sugar ring or 4' position of a six membered sugar ring of a nucleoside of $[B_o]$).

wherein at least one of $[A_n]$ or $[B_o]$ includes the structure of Formula IV:

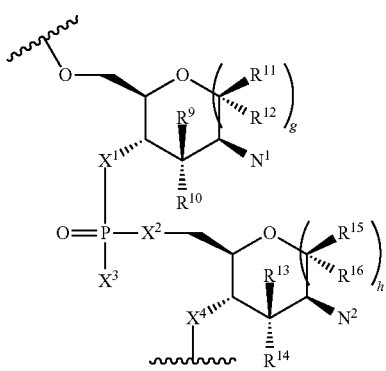

Formula IV wherein each of $N^1$ and $N^2$ is independently a nucleobase;

each of $R^9$, $R^{10}$, $R^{11}$, $R^{12}$, $R^{13}$, $R^{14}$, $R^{15}$, and $R^{16}$ is, independently, H, halo, hydroxy, thiol, optionally substituted $C_1$-$C_6$ alkyl, optionally substituted $C_1$-$C_6$ heteroalkyl, optionally substituted $C_2$-$C_6$ heteroalkenyl, optionally substituted $C_2$-$C_6$ heteroalkynyl, optionally substituted amino, azido, or optionally substituted $C_6$-$C_{10}$ aryl;

each of g and h is, independently, 0 or 1;

each $X^1$ and $X^4$ is, independently, O, NH, or S; and each $X^2$ is independently O or S; and each $X^3$ is OH or SH, or a salt thereof;

wherein at least one of $X^1$, $X^2$, or $X^4$ is NH or S.

In some embodiments, $X^1$ is NH. In other embodiments, $X^4$ is NH. In certain embodiments, $X^2$ is S.

In some embodiments, the polynucleotide includes: (a) a coding region; (b) a 5' UTR including at least one Kozak sequence; (c) a 3' UTR; and (d) at least one 5' cap structure. In other embodiments, the polynucleotide further includes (e) a poly-A tail.

In some embodiments, one of the coding region, the 5' UTR including at least one Kozak sequence, the 3' UTR, the 5' cap structure, or the poly-A tail includes $[A_n]$-$L^1$-$[B_o]$.

In other embodiments, one of the coding region, the 5' UTR including at least one Kozak sequence, the 3' UTR, the 5' cap structure, or the poly-A tail includes $[A_n]$ and another of the coding region, the 5' UTR including at least one Kozak sequence, the 3' UTR, the 5' cap structure, or the poly-A tail includes $[B_o]$.

In certain embodiments, the polynucleotide includes at least one modified nucleoside (e.g., a nucleoside of Table 2).

In some embodiments, $R^4$ is optionally substituted $C_{2-9}$ heterocyclylene, for example, the heterocycle may have the structure:

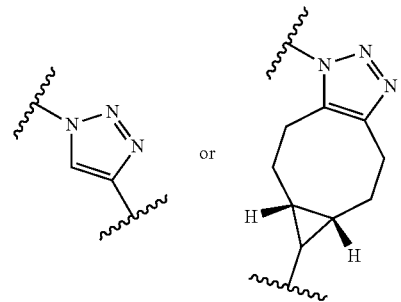

In certain embodiments, $L^1$ is attached to $[A_n]$ at the 3' position of a five-membered sugar ring or 4' position of a six membered sugar ring of one of the nucleosides and to $[B_o]$ at the 5' position of a five-membered sugar ring or 6' position of a six membered sugar ring of one of the nucleosides.

In some embodiments, the polynucleotide is circular.

In another aspect, the invention features a method of producing a composition including a chimeric polynucleotide encoding a polypeptide, wherein the polynucleotide includes the structure of Formula V:

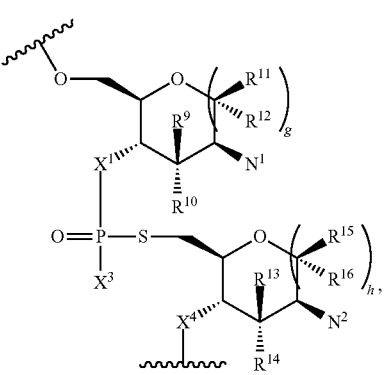

Formula V

This method includes reacting a compound having the structure of Formula VI:

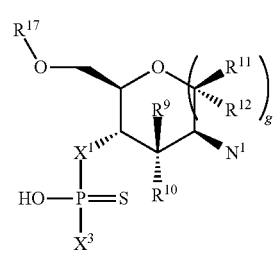

Formula VI with a compound having the structure of Formula VII:

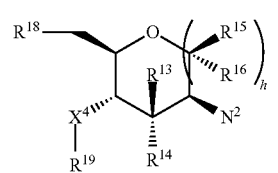

Formula VII wherein each of $N^1$ and $N^2$ is, independently, a nucleobase;

each of $R^9$, $R^{10}$, $R^{11}$, $R^{12}$, $R^{13}$, $R^{14}$, $R^{15}$, and $R^{16}$ is, independently, H, halo, hydroxy, thiol, optionally substituted $C_1$-$C_6$ alkyl, optionally substituted $C_1$-$C_6$ heteroalkyl, optionally substituted $C_2$-$C_6$ heteroalkenyl, optionally substituted $C_2$-$C_6$ heteroalkynyl, optionally substituted amino, azido, or optionally substituted $C_6$-$C_{10}$ aryl;

each of g and h is, independently, 0 or 1;

each $X^1$ and $X^4$ is, independently, O, NH, or S; and each $X^3$ is independently OH or SH, or a salt thereof;

each of $R^{17}$ and $R^{19}$ is, independently, a region of linked nucleosides; and $R^{18}$ is a halogen.

In another aspect, the invention features a method of producing a composition including a chimeric polynucleotide encoding a polypeptide, wherein the polynucleotide includes the structure of Formula VIII:

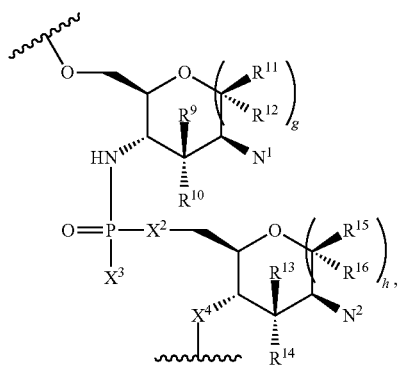

Formula VIII

This method includes reacting a compound having the structure of Formula IX:

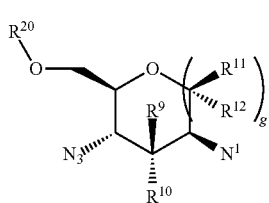

Formula IX with a compound having the structure of Formula X:

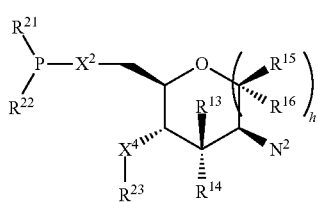

Formula X wherein each of $N^1$ and $N^2$ is, independently, a nucleobase;

each of $R^9$, $R^{10}$, $R^{11}$, $R^{12}$, $R^{13}$, $R^{14}$, $R^{15}$, and $R^{16}$ is, independently, H, halo, hydroxy, thiol, optionally substituted $C_1$-$C_6$ alkyl, optionally substituted $C_1$-$C_6$ heteroalkyl, optionally substituted $C_2$-$C_6$ heteroalkenyl, optionally substituted $C_2$-$C_6$ heteroalkynyl, optionally substituted amino, azido, or optionally substituted $C_6$-$C_{10}$ aryl;

each of g and h is, independently, 0 or 1;

each $X^4$ is, independently, O, NH, or S; and each $X^2$ is independently O or S;

each $X^3$ is independently OH, SH, or a salt thereof;

each of $R^{20}$ and $R^{23}$ is, independently, a region of linked nucleosides; and each of $R^{21}$ and $R^{22}$ is, independently, optionally substituted $C_1$-$C_6$ alkoxy.

In another aspect, the invention features a method of producing a composition including a chimeric polynucleotide encoding a polypeptide, wherein the polynucleotide includes the structure of Formula XI:

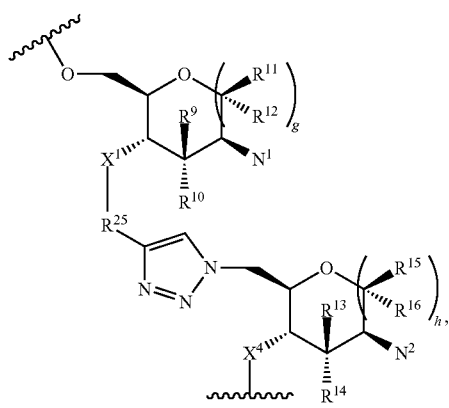

Formula XI

This method includes reacting a compound having the structure of Formula XII:

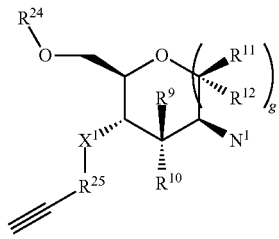

Formula XII with a compound having the structure of Formula XIII:

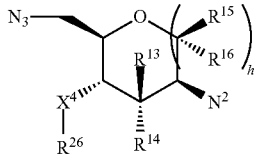

Formula XIII wherein each of $N^1$ and $N^2$ is, independently, a nucleobase;

each of $R^9$, $R^{10}$, $R^{11}$, $R^{12}$, $R^{13}$, $R^{14}$, $R^{15}$, and $R^{16}$ is, independently, H, halo, hydroxy, thiol, optionally substituted $C_1$-$C_6$ alkyl, optionally substituted $C_1$-$C_6$ heteroalkyl, optionally substituted C$_2$-C$_6$ heteroalkenyl, optionally substituted C$_2$-C$_6$ heteroalkynyl, optionally substituted amino, azido, or optionally substituted C$_6$-C$_{10}$ aryl;

each of g and h is, independently, 0 or 1;

each X$^4$ is, independently, O, NH, or S; and each X$^2$ is independently O or S;

each X$^3$ is independently OH, SH, or a salt thereof;

each of R$^{24}$ and R$^{26}$ is, independently, a region of linked nucleosides; and R$^{25}$ is optionally substituted C$_1$-C$_6$ alkylene or optionally substituted C$_1$-C$_6$ heteroalkylene or R$^{25}$ and the alkynyl group together form optionally substituted cycloalkynyl.

In another aspect, the invention features a method of producing a composition including a chimeric polynucleotide encoding a polypeptide, wherein the polynucleotide has a sequence including Formula II:

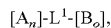  Formula II

This method includes reacting a compound having the structure of Formula XIV

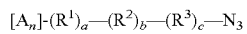  Formula XIV with a compound having the structure of Formula XV:

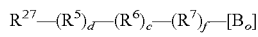  Formula XV wherein each A and B is independently any nucleoside;

n and o are, independently 15 to 1000; and

L$^1$ has the structure of Formula III:

Formula III

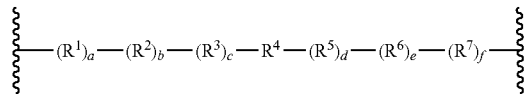

wherein a, b, c, d, e, and f are each, independently, 0 or 1;

wherein each A and B is independently any nucleoside;

n and o are, independently 15 to 1000;

R$^1$, R$^3$, R$^5$, and R$^7$ each, independently, is selected from optionally substituted C$_1$-C$_6$ alkylene, optionally substituted C$_1$-C$_6$ heteroalkylene, O, S, and NR$^8$;

R$^2$ and R$^6$ are each, independently, selected from carbonyl, thiocarbonyl, sulfonyl, or phosphoryl;

R$^4$ is an optionally substituted triazolene; and

R$^8$ is hydrogen, optionally substituted C$_1$-C$_4$ alkyl, optionally substituted C$_3$-C$_4$ alkenyl, optionally substituted C$_2$-C$_4$ alkynyl, optionally substituted C$_2$-C$_6$ heterocyclyl, optionally substituted C$_6$-C$_{12}$ aryl, or optionally substituted C$_1$-C$_7$ heteroalkyl; and R$^{27}$ is an optionally substituted C$_2$-C$_3$ alkynyl or an optionally substituted C$_8$-C$_{12}$ cycloalkynyl, wherein L$^1$ is attached to [A$_n$] and [B$_o$] at the sugar of one of the nucleosides.

In some embodiments, the optionally substituted triazolene has the structure:

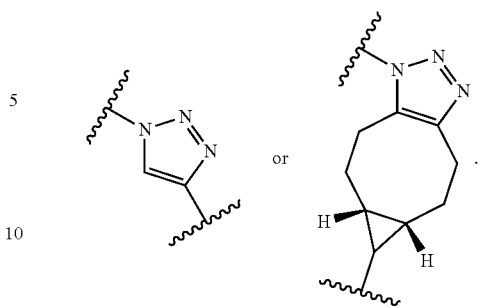

In one embodiment, at least one of the regions of linked nucleosides of A may comprise a sequence of linked nucleosides which can function as a 5' untranslated region (UTR). The sequence of linked nucleosides may be a natural or synthetic 5' UTR. As a non-limiting example, the chimeric polynucleotide may encode a polypeptide of interest and the sequence of linked nucleosides of A may encode the native 5' UTR of a polypeptide encoded by the chimeric polynucleotide or the sequence of linked nucleosides may be a non-heterologous 5' UTR such as, but not limited to a synthetic UTR.

In another embodiment, at least one of the regions of linked nucleosides of A may be a cap region. The cap region may be located 5' to a region of linked nucleosides of A functioning as a 5'UTR. The cap region may comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, at least one of the regions of linked nucleosides of B may comprise at least one open reading frame of a nucleic acid sequence. The nucleic acid sequence may be codon optimized and/or comprise at least one modification.

In one embodiment, at least one of the regions of linked nucleosides of C may comprise a sequence of linked nucleosides which can function as a 3' UTR. The sequence of linked nucleosides may be a natural or synthetic 3' UTR. As a non-limiting example, the chimeric polynucleotide may encode a polypeptide of interest and the sequence of linked nucleosides of C may encode the native 3' UTR of a polypeptide encoded by the chimeric polynucleotide or the sequence of linked nucleosides may be a non-heterologous 3' UTR such as, but not limited to a synthetic UTR.

In one embodiment, at least one of the regions of linked nucleosides of A comprises a sequence of linked nucleosides which functions as a 5' UTR and at least one of the regions of linked nucleosides of C comprises a sequence of linked nucleosides which functions as a 3' UTR. In one embodiment, the 5' UTR and the 3' UTR may be from the same or different species. In another embodiment, the 5' UTR and the 3' UTR may encode the native untranslated regions from different proteins from the same or different species.

FIGS. 4 and 5 provide schematics of a series of chimeric polynucleotides illustrating various patterns of positional modifications based on Formula I as well as those having a blocked or structured 3' terminus.

Chimeric polynucleotides, including the parts or regions thereof, of the present invention may be classified as hemimers, gapmers, wingmers, or blockmers.

As used herein, a "hemimer" is chimeric polynucleotide comprising a region or part which comprises half of one pattern, percent, position or population of a chemical modification(s) and half of a second pattern, percent, position or population of a chemical modification(s). Chimeric polynucleotides of the present invention may also comprise hemimer subregions. In one embodiment, a part or region is 50% of one and 50% of another.

In one embodiment the entire chimeric polynucleotide can be 50% of one and 50% of the other. Any region or part of any chimeric polynucleotide of the invention may be a hemimer. Types of hemimers include pattern hemimers, population hemimers or position hemimers. By definition, hemimers are 50:50 percent hemimers.

As used herein, a "gapmer" is a chimeric polynucleotide having at least three parts or regions with a gap between the parts or regions. The "gap" can comprise a region of linked nucleosides or a single nucleoside which differs from the chimeric nature of the two parts or regions flanking it. The two parts or regions of a gapmer may be the same or different from each other.

As used herein, a "wingmer" is a chimeric polynucleotide having at least three parts or regions with a gap between the parts or regions. Unlike a gapmer, the two flanking parts or regions surrounding the gap in a wingmer are the same in degree or kind. Such similarity may be in the length of number of units of different modifications or in the number of modifications. The wings of a wingmer may be longer or shorter than the gap. The wing parts or regions may be 20, 30, 40, 50, 60 70, 80, 90 or 95% greater or shorter in length than the region which comprises the gap.

As used herein, a "blockmer" is a patterned polynucleotide where parts or regions are of equivalent size or number and type of modifications. Regions or subregions in a blockmer may be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides long.

Chimeric polynucleotides, including the parts or regions thereof, of the present invention having a chemical modification pattern are referred to as "pattern chimeras." Pattern chimeras may also be referred to as blockmers. Pattern chimeras are those polynucleotides having a pattern of modifications within, across or among regions or parts.

Patterns of modifications within a part or region are those which start and stop within a defined region. Patterns of modifications across a part or region are those patterns which start in on part or region and end in another adjacent part or region. Patterns of modifications among parts or regions are those which begin and end in one part or region and are repeated in a different part or region, which is not necessarily adjacent to the first region or part.

The regions or subregions of pattern chimeras or blockmers may have simple alternating patterns such as ABAB [AB]n where each "A" and each "B" represent different chemical modifications (at at least one of the base, sugar or backbone linker), different types of chemical modifications (e.g., naturally occurring and non-naturally occurring), different percentages of modifications or different populations of modifications. The pattern may repeat n number of times where n=3-300. Further, each A or B can represent from 1-2500 units (e.g., nucleosides) in the pattern. Patterns may also be alternating multiples such as AABBAABB[AABB]n (an alternating double multiple) or AAABBBAAABBB [AAABBB]n (an alternating triple multiple) pattern. The pattern may repeat n number of times where n=3-300.

Different patterns may also be mixed together to form a second order pattern. For example, a single alternating pattern may be combined with a triple alternating pattern to form a second order alternating pattern A'B'. One example would be [ABABAB][AAABBBAAABBB] [ABABAB] [AAABBBAAABBB] [ABABAB][AAABBBAAABBB], where [ABABAB] is A' and [AAABBBAAABBB] is B'. In like fashion, these patterns may be repeated n number of times, where n=3-300.

Patterns may include three or more different modifications to form an ABCABC[ABC]n pattern. These three component patterns may also be multiples, such as AABBC-CAABBCC[AABBCC]n and may be designed as combinations with other patterns such as ABCABCAABBCCABCABCAABBCC, and may be higher order patterns.

Regions or subregions of position, percent, and population modifications need not reflect an equal contribution from each modification type. They may form series such as "1-2-3-4", "1-2-4-8", where each integer represents the number of units of a particular modification type. Alternatively, they may be odd only, such as '1-3-3-1-3-1-5" or even only "2-4-2-4-6-4-8" or a mixture of both odd and even number of units such as "1-3-4-2-5-7-3-3-4".

Pattern chimeras may vary in their chemical modification by degree (such as those described above) or by kind (e.g., different modifications).

Chimeric polynucleotides, including the parts or regions thereof, of the present invention having at least one region with two or more different chemical modifications of two or more nucleoside members of the same nucleoside type (A, C, G, T, or U) are referred to as "positionally modified" chimeras. Positionally modified chimeras are also referred to herein as "selective placement" chimeras or "selective placement polynucleotides". As the name implies, selective placement refers to the design of polynucleotides which, unlike polynucleotides in the art where the modification to any A, C, G, T or U is the same by virtue of the method of synthesis, can have different modifications to the individual As, Cs, Gs, Ts or Us in a polynucleotide or region thereof. For example, in a positionally modified chimeric polynucleotide, there may be two or more different chemical modifications to any of the nucleoside types of As, Cs, Gs, Ts, or Us. There may also be combinations of two or more to any two or more of the same nucleoside type. For example, a positionally modified or selective placement chimeric polynucleotide may comprise 3 different modifications to the population of adenines in the molecule and also have 3 different modifications to the population of cytosines in the construct all of which may have a unique, non-random, placement.

Chimeric polynucleotides, including the parts or regions thereof, of the present invention having a chemical modification percent are referred to as "percent chimeras." Percent chimeras may have regions or parts which comprise at least 1%, at least 2%, at least 5%, at least 8%, at least 10%, at least 20%, at least 30%, at least 40%, at least 50%, at least 60%, at least 70%, at least 80%, at least 90%, at least 95%, or at least 99% positional, pattern or population of modifications. Alternatively, the percent chimera may be completely modified as to modification position, pattern, or population. The percent of modification of a percent chimera may be split between naturally occurring and non-naturally occurring modifications.

Chimeric polynucleotides, including the parts or regions thereof, of the present invention having a chemical modification population are referred to as "population chimeras." A population chimera may comprise a region or part where nucleosides (their base, sugar or backbone linkage, or combination thereof) have a select population of modifications. Such modifications may be selected from functional populations such as modifications which induce, alter or modulate a phenotypic outcome. For example, a functional population may be a population or selection of chemical modifications which increase the level of a cytokine. Other functional populations may individually or collectively function to decrease the level of one or more cytokines. Use of a selection of these like-function modifications in a chimeric polynucleotide would therefore constitute a "functional population chimera." As used herein, a "functional population chimera" may be one whose unique functional feature is defined by the population of modifications as described above or the term may apply to the overall function of the chimeric polynucleotide itself. For example, as a whole the chimeric polynucleotide may function in a different or superior way as compared to an unmodified or non-chimeric polynucleotide.

It should be noted that polynucleotides which have a uniform chemical modification of all of any of the same nucleoside type or a population of modifications produced by mere downward titration of the same starting modification in all of any of the same nucleoside type, or a measured percent of a chemical modification of all any of the same nucleoside type but with random incorporation, such as where all uridines are replaced by a uridine analog, e.g., pseudouridine, are not considered chimeric. Likewise, polynucleotides having a uniform chemical modification of two, three, or four of the same nucleoside type throughout the entire polynucleotide (such as all uridines and all cytosines, etc. are modified in the same way) are not considered chimeric polynucleotides. One example of a polynucleotide which is not chimeric is the canonical pseudouridine/5-methyl cytosine modified polynucleotide of the prior art. These uniform polynucleotides are arrived at entirely via in vitro transcription (IVT) enzymatic synthesis; and due to the limitations of the synthesizing enzymes, they contain only one kind of modification at the occurrence of each of the same nucleoside type, i.e., adenosine (A), thymidine (T), guano sine (G), cytidine (C) or uradine (U), found in the polynucleotide. Such polynucleotides may be characterized as IVT polynucleotides.

The chimeric polynucleotides of the present invention may be structurally modified or chemically modified. When the chimeric polynucleotides of the present invention are chemically and/or structurally modified the polynucleotides may be referred to as "modified chimeric polynucleotides."

In some embodiments of the invention, the chimeric polynucleotides may encode two or more peptides or polypeptides of interest. Such peptides or polypeptides of interest include the heavy and light chains of antibodies, an enzyme and its substrate, a label and its binding molecule, a second messenger and its enzyme or the components of multimeric proteins or complexes.

The regions or parts of the chimeric polynucleotides of the present invention may be separated by a linker or spacer moiety. Such linkers or spaces may be nucleic acid based or non-nucleosidic.

In one embodiment, the chimeric polynucleotides of the present invention may include a sequence encoding a self-cleaving peptide described herein, such as, but not limited to, a 2A peptide. The polynucleotide sequence of the 2A peptide in the chimeric polynucleotide may be modified or codon optimized by the methods described herein and/or are known in the art.

Notwithstanding the foregoing, the chimeric polynucleotides of the present invention may comprise a region or part which is not positionally modified or not chimeric as defined herein.

For example, a region or part of a chimeric polynucleotide may be uniformly modified at one ore more A, T, C, G, or U but according to the invention, the polynucleotides will not be uniformly modified throughout the entire region or part.

Regions or parts of chimeric polynucleotides may be from 15-1000 nucleosides in length and a polynucleotide may have from 2-100 different regions or patterns of regions as described herein.

In one embodiment, chimeric polynucleotides encode one or more polypeptides of interest. In another embodiment, the chimeric polynucleotides are substantially non-coding. In another embodiment, the chimeric polynucleotides have both coding and non-coding regions and parts.

FIG. 2 illustrates the design of certain chimeric polynucleotides of the present invention when based on the scaffold of the polynucleotide of FIG. 1. Shown in the figure are the regions or parts of the chimeric polynucleotides where patterned regions represent those regions which are positionally modified and open regions illustrate regions which may or may not be modified but which are, when modified, uniformly modified. Chimeric polynucleotides of the present invention may be completely positionally modified or partially positionally modified. They may also have subregions which may be of any pattern or design. Shown in FIG. 2 are a chimeric subregion and a hemimer subregion.

In one embodiment, the shortest length of a region of the chimeric polynucleotide of the present invention encoding a peptide can be the length that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

In one embodiment, the length of a region of the chimeric polynucleotide of the present invention encoding the peptide or polypeptide of interest is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In some embodiments, the chimeric polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, regions or subregions of the chimeric polynucleotides may also range independently from 15-1,000 nucleotides in length (e.g., greater than 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900 and 950 nucleotides or at least 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900, 950 and 1,000 nucleotides).

According to the present invention, regions or subregions of chimeric polynucleotides may range from absent to 500 nucleotides in length (e.g., at least 60, 70, 80, 90, 100, 110, 120, 130, 140, 150, 160, 170, 180, 190, 200, 250, 300, 350, 400, 450, or 500 nucleotides). Where the region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides to about 160 nucleotides are functional. The chimeric polynucleotides of the present invention which function as an mRNA need not comprise a polyA tail.

According to the present invention, chimeric polynucleotides which function as an mRNA may have a capping region. The capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

The present invention contemplates chimeric polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example U.S. Provisional Application No. 61/873,010 filed Sep. 3, 2013, the contents of which are incorporated herein by reference in their entirety, may be made chimeric according to the present invention.

Chimeric polynucleotides, formulations and compositions comprising chimeric polynucleotides, and methods of making, using and administering chimeric polynucleotides are also described in U.S. Provisional Application No. 61/873,034, filed Sep. 3, 2013, entitled Chimeric Polynucleotides, and U.S. Provisional Application No. 61/877,582, filed Sep. 13, 2013, entitled Chimeric Polynucleotides; each of which is incorporated by reference in its entirety.

Circular Polynucleotide Architecture

The present invention contemplates polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example U.S. Provisional Application No. 61/873,010 filed Sep. 3, 2013, the contents of which are incorporated herein by reference in their entirety.

Circular polynucleotides of the present invention may be designed according to the circular RNA construct scaffolds shown in FIGS. 6-12. Such polynucleotides are circular polynucleotides or circular constructs.

The circular polynucleotides or circPs of the present invention which encode at least one peptide or polypeptide of interest are known as circular RNAs or circRNA. The antigens of the NAVs of the present invention may be encoded by one or more circular RNAs or circRNAs.

As used herein, "circular RNA" or "circRNA" means a circular polynucleotide that can encode at least one peptide or polypeptide of interest. The circPs of the present invention which comprise at least one sensor sequence and do not encode a peptide or polypeptide of interest are known as circular sponges or circSP. As used herein, "circular sponges," "circular polynucleotide sponges" or "circSP" means a circular polynucleotide which comprises at least one sensor sequence and does not encode a polypeptide of interest. Such noncoding polynucleotides may be useful in the NAVs of the present invention as noncoding nucleic acids may function as an antigenic composition.

As used herein, "sensor sequence" means a receptor or pseudo-receptor for endogenous nucleic acid binding molecules. Non-limiting examples of sensor sequences include, microRNA binding sites, microRNA seed sequences, microRNA binding sites without the seed sequence, transcription factor binding sites and artificial binding sites engineered to act as pseudo-receptors and portions and fragments thereof.

The circPs of the present invention which comprise at least one sensor sequence and encode at least one peptide or polypeptide of interest are known as circular RNA sponges or circRNA-SP. As used herein, "circular RNA sponges" or "circRNA-SP" means a circular polynucleotide which comprises at least one sensor sequence and at least one region encoding at least one peptide or polypeptide of interest.

Figure 6A:
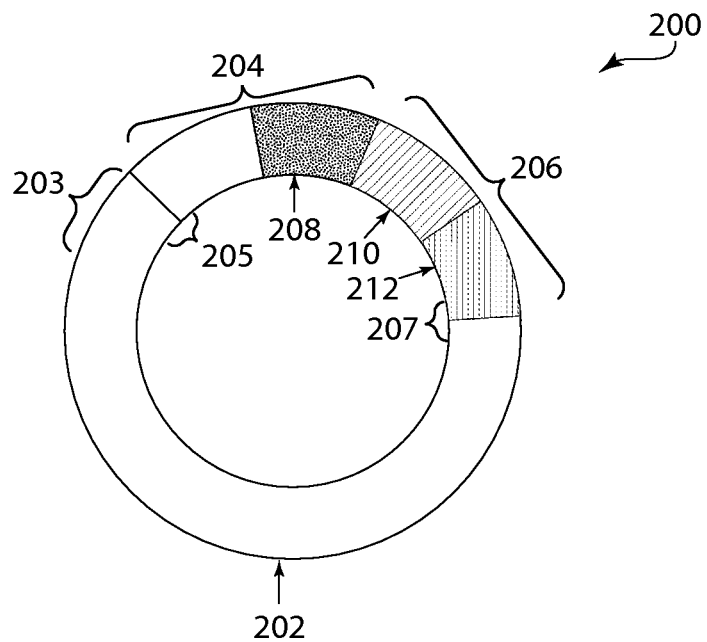
FIGS. 6A and 6B are schematics of circular constructs of the present invention.

FIG. 6A shows a representative circular construct 200 of the circular polynucleotides of the present invention. As used herein, the term "circular construct" refers to a circular polynucleotide transcript which may act substantially similar to and have properties of a RNA molecule. In one embodiment the circular construct acts as an mRNA. If the circular construct encodes one or more peptides or polypeptides of interest (e.g., a circRNA or circRNA-SP) then the polynucleotide transcript retains sufficient structural and/or chemical features to allow the polypeptide of interest encoded therein to be translated. Circular constructs may be polynucleotides of the invention. When structurally or chemically modified, the construct may be referred to as a modified circP, modified circSP, modified circRNA or modified circRNA-SP.

Returning to FIG. 6A, the circular construct 200 here contains a first region of linked nucleotides 202 that is flanked by a first flanking region 204 and a second flanking region 206. As used herein, the "first region" may be referred to as a "coding region," a "non-coding region" or "region encoding" or simply the "first region." In one embodiment, this first region may comprise nucleotides such as, but is not limited to, encoding at least one peptide or polypeptide of interest and/or nucleotides encoding a sensor region. The peptide or polypeptide of interest may comprise at its 5' terminus one or more signal peptide sequences encoded by a signal peptide sequence region 203. The first flanking region 204 may comprise a region of linked nucleosides or portion thereof which may act similarly to an untranslated region (UTR) in an mRNA and/or DNA sequence. The first flanking region may also comprise a region of polarity 208. The region of polarity 208 may include an IRES sequence or portion thereof. As a non-limiting example, when linearized this region may be split to have a first portion be on the 5' terminus of the first region 202 and second portion be on the 3' terminus of the first region 202. The second flanking region 206 may comprise a tailing sequence region 210 and may comprise a region of linked nucleotides or portion thereof 212 which may act similarly to a UTR in an mRNA and/or DNA.

Bridging the 5' terminus of the first region 202 and the first flanking region 104 is a first operational region 205. In one embodiment, this operational region may comprise a start codon. The operational region may alternatively comprise any translation initiation sequence or signal including a start codon.

Bridging the 3' terminus of the first region 202 and the second flanking region 106 is a second operational region 207. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

Figure 6B:
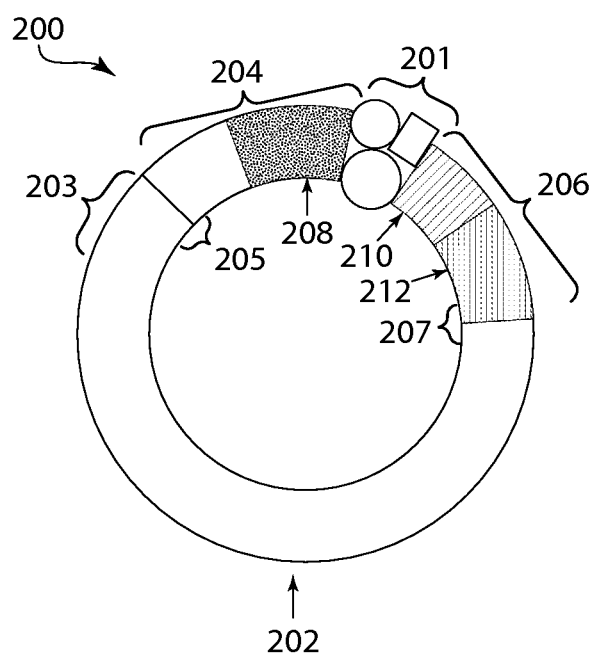

Turning to FIG. 6B, at least one non-nucleic acid moiety 201 may be used to prepare a circular construct 200 where the non-nucleic acid moiety 201 is used to bring the first flanking region 204 near the second flanking region 206. Non-limiting examples of non-nucleic acid moieties which may be used in the present invention are described herein. The circular construct 200 may comprise more than one non-nucleic acid moiety wherein the additional non-nucleic acid moeities may be heterologous or homologous to the first non-nucleic acid moiety.

Figure 7A:
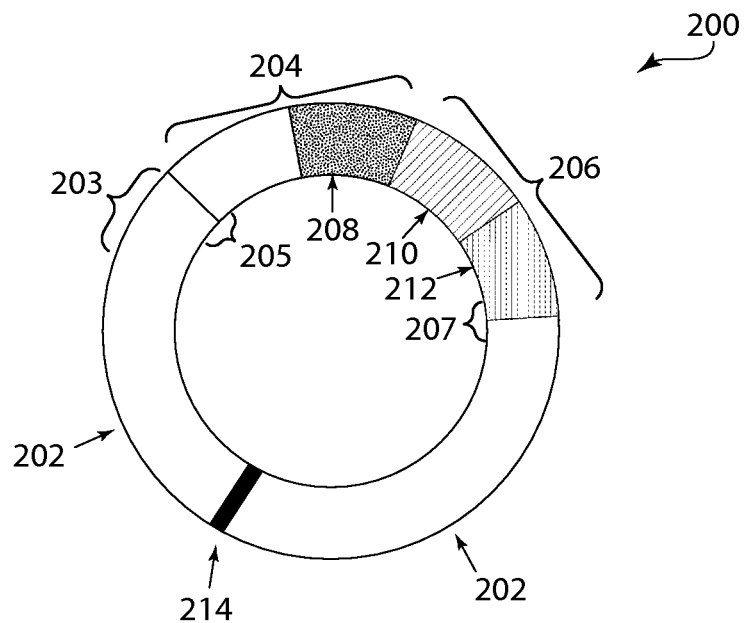
FIGS. 7A-7B are schematics of circular constructs of the present invention.

Turning to FIG. 7A, the first region of linked nucleosides 202 may comprise a spacer region 214. This spacer region 214 may be used to separate the first region of linked nucleosides 202 so that the circular construct can include more than one open reading frame, non-coding region or an open reading frame and a non-coding region.

Figure 7B:
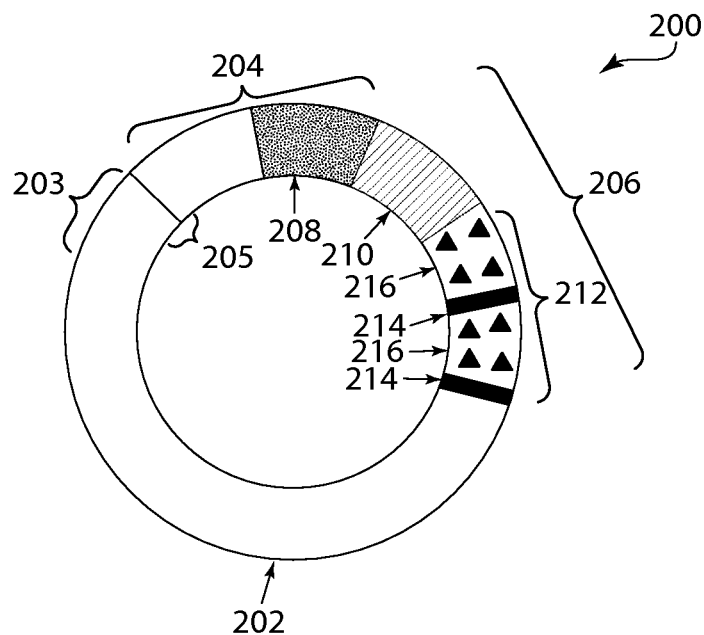
Figure 9:
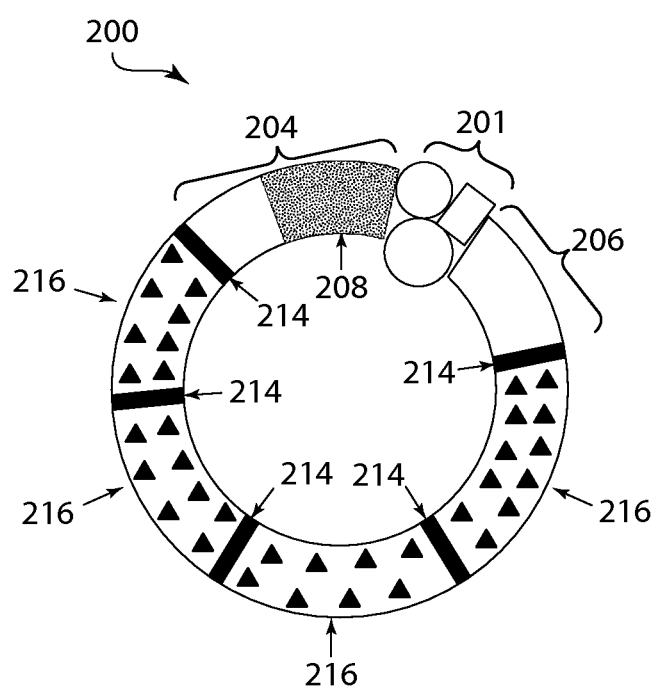
FIG. 9 is a schematic of a non-coding circular construct of the present invention.
Figure 10:
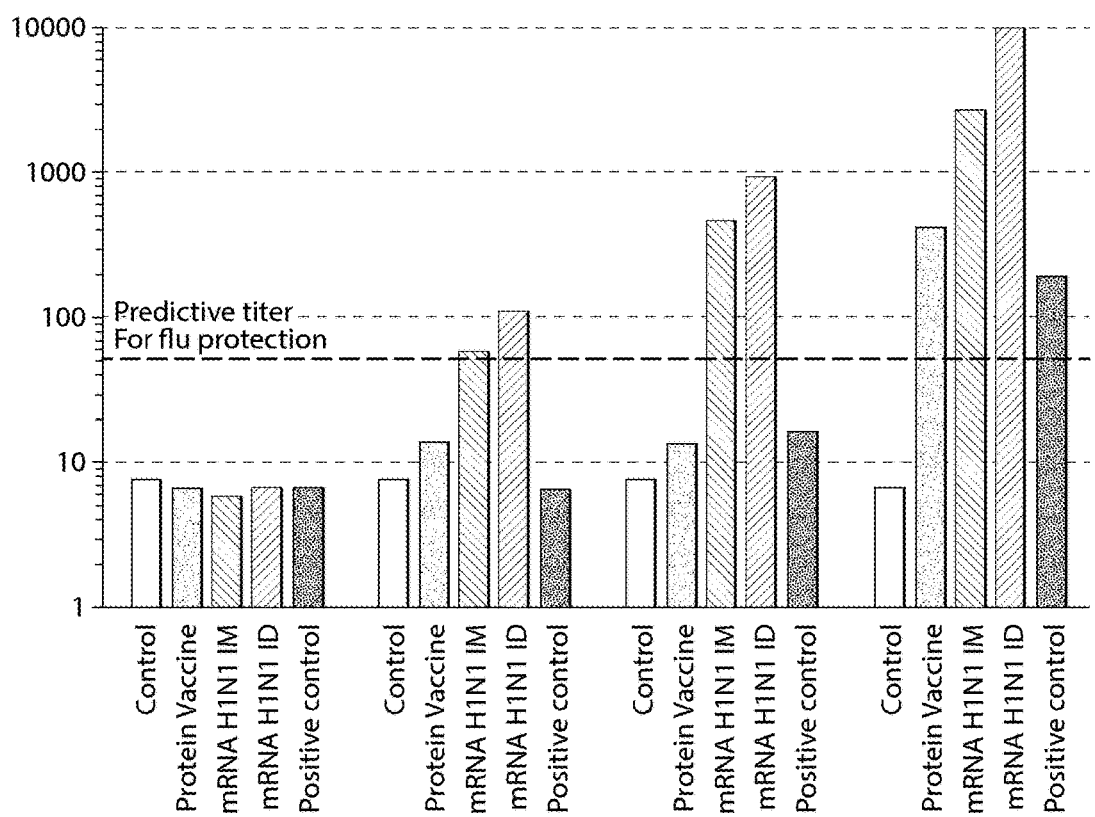
FIG. 10 shows HA neutralization titres of a chemically modified mRNA influenza vaccine in comparison with protein and unmodified mRNA vaccines.
Figure 11:
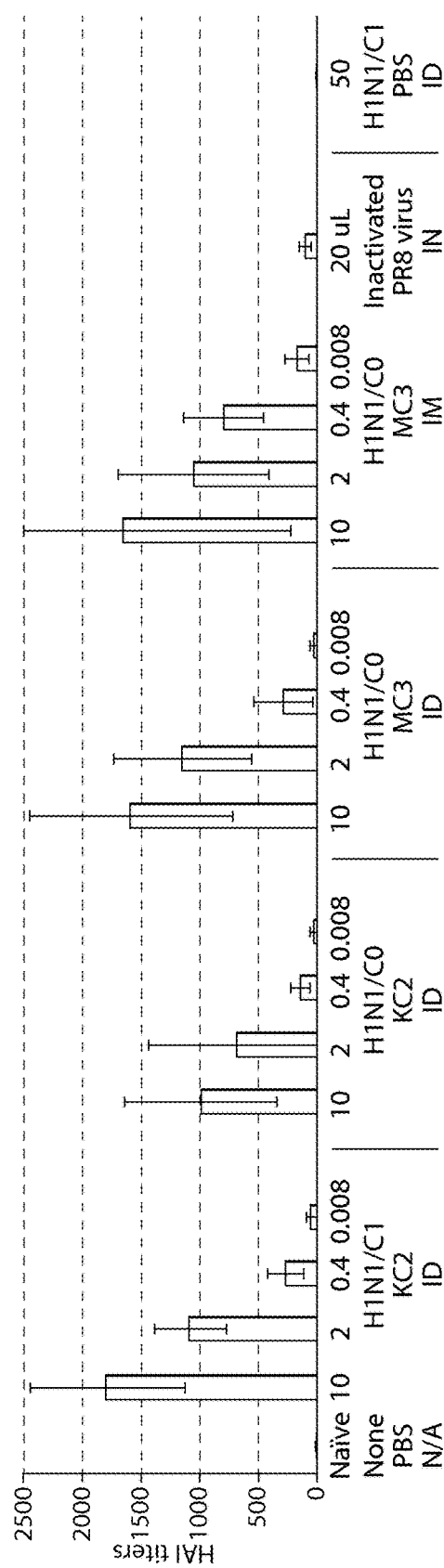
FIG. 11 shows hemagglutinin inhibition titers in mice following vaccination with different doses and formulations of mRNA encoding the hemagglutinin protein of the H1N1 virus.
Figure 12A:
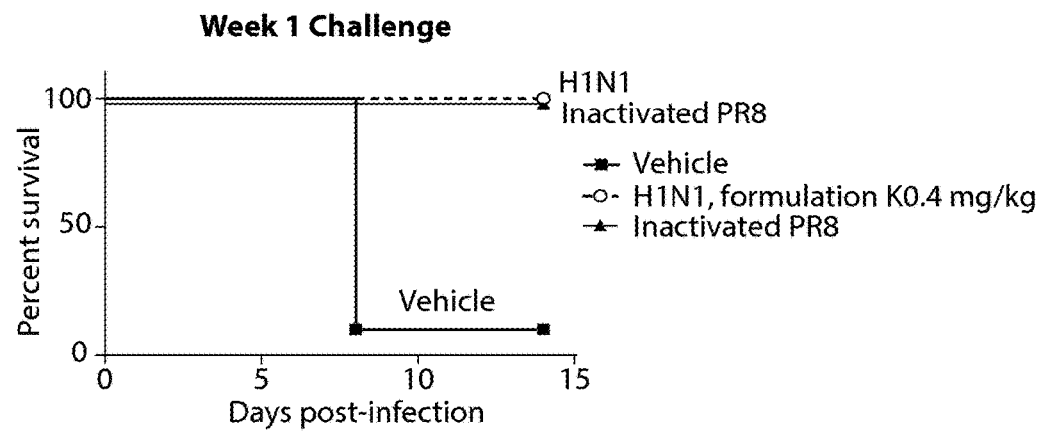
FIGS. 12A-12D show percent survival of mice after vaccination and challenge with influenza A/PR/8/34 virus.
Figure 12B:
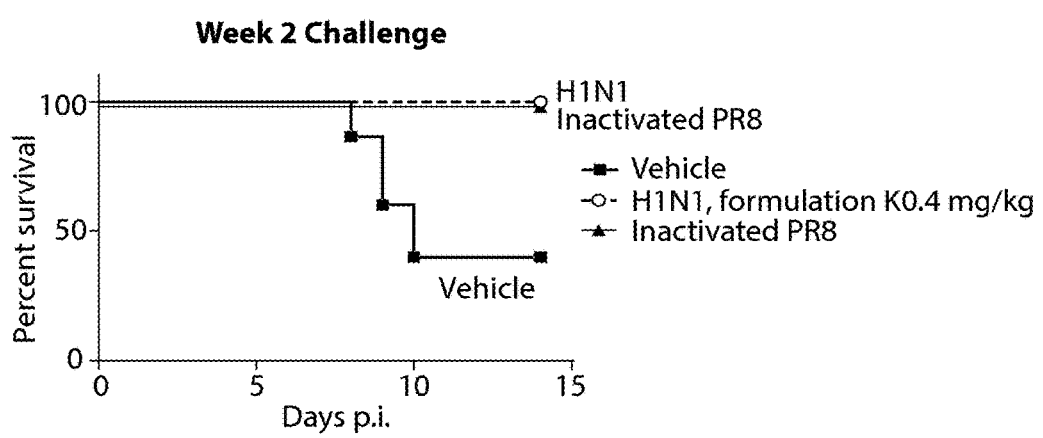
Figure 12C:
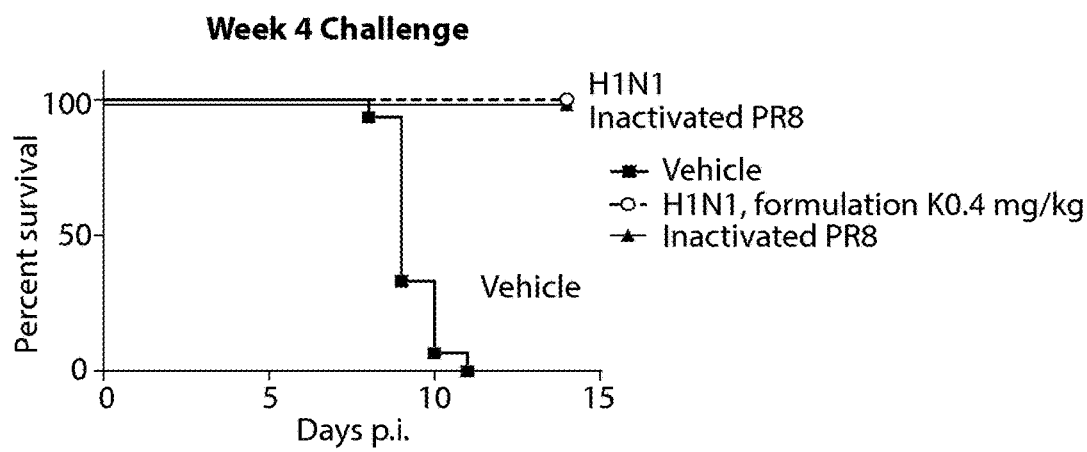
Figure 12D:
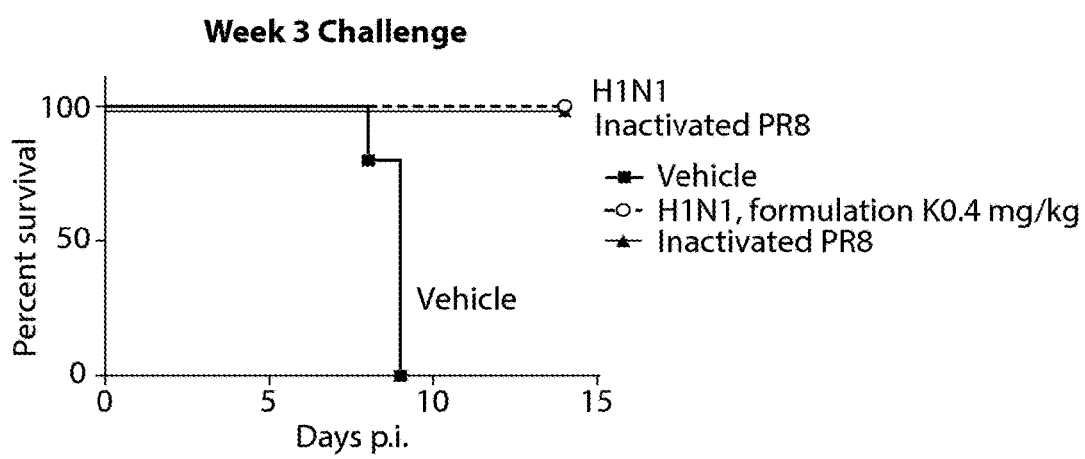

Turning to FIG. 7B, the second flanking region 206 may comprise one or more sensor regions 216 in the 3'UTR 212. These sensor sequences as discussed herein operate as pseudo-receptors (or binding sites) for ligands of the local microenvironment of the circular construct. For example, microRNA binding sites or miRNA seeds may be used as sensors such that they function as pseudoreceptors for any microRNAs present in the environment of the circular polynucleotide. As shown in FIG. 9, the one or more sensor regions 216 may be separated by a spacer region 214.

Figure 8A:
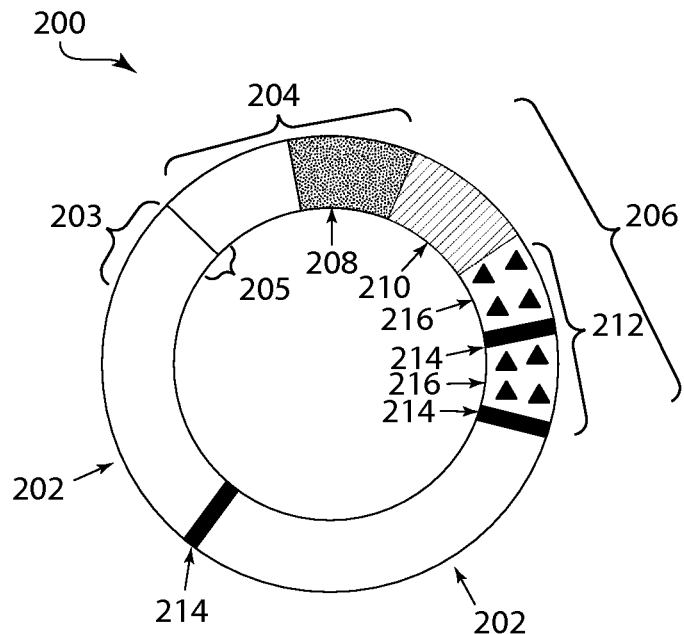
FIGS. 8A-8B are schematics of a circular constructs of the present invention.

As shown in FIG. 8A, a circular construct 200, which includes one or more sensor regions 216, may also include a spacer region 214 in the first region of linked nucleosides 202. As discussed above for FIG. 7, this spacer region 214 may be used to separate the first region of linked nucleosides 202 so that the circular construct can include more than one open reading frame and/or more than one non-coding region.

Figure 8B:
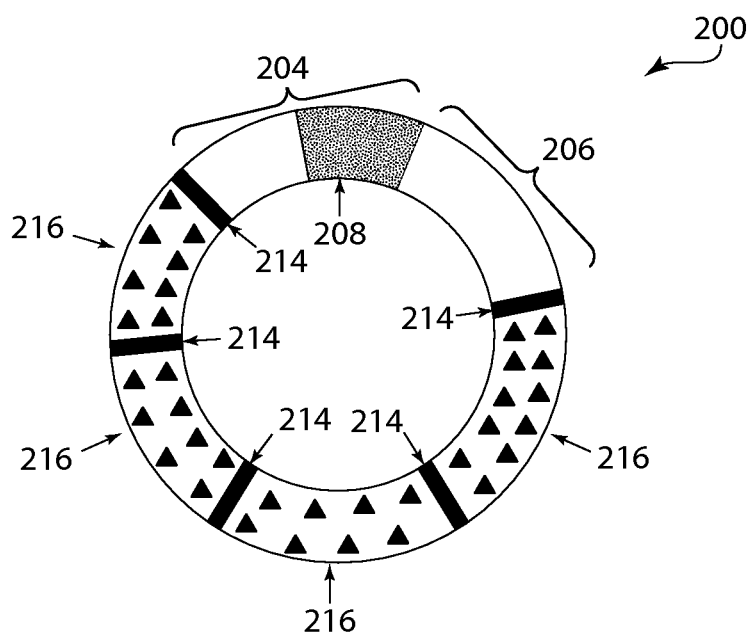

Turning to FIG. 8B, a circular construct 200 may be a non-coding construct known as a circSP comprising at least one non-coding region such as, but not limited to, a sensor region 216. Each of the sensor regions 216 may include, but are not limited to, a miR sequence, a miR seed, a miR binding site and/or a miR sequence without the seed.

Turning to FIG. 9, at least one non-nucleic acid moiety 201 may be used to prepare a circular construct 200 which is a non-coding construct. The circular construct 200 which is a non-coding construct may comprise more than one non-nucleic acid moiety wherein the additional non-nucleic acid moeities may be heterologous or homologous to the first non-nucleic acid moiety.

Circular polynucleotides, formulations and compositions comprising circular polynucleotides, and methods of making, using and administering circular polynucleotides are also described in U.S. Provisional Application No. 61/873, 010, filed Sep. 3, 2013, entitled Circular Polynucleotides, and U.S. Provisional Application No. 61/877,527, filed Sep. 13, 2013, entitled Circular Polynucleotides; each of which is incorporated by reference in its entirety.

Multimers of Polynucleotides

According to the present invention, multiple distinct chimeric polynucleotides and/or IVT polynucleotides may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into cells at a 1:1 ratio to alter cellular fatty acid metabolism. This ratio may be controlled by chemically linking chimeric polynucleotides and/or IVT polynucleotides using a 3'-azido terminated nucleotide on one polynucleotides species and a C5-ethynyl or alkynyl-containing nucleotide on the opposite polynucleotide species. The modified nucleotide is added post-transcriptionally using terminal transferase (New England Biolabs, Ipswich, Mass.) according to the manufacturer's protocol. After the addition of the 3'-modified nucleotide, the two polynucleotides species may be combined in an aqueous solution, in the presence or absence of copper, to form a new covalent linkage via a click chemistry mechanism as described in the literature.

In another example, more than two chimeric polynucleotides and/or IVT polynucleotides may be linked together using a functionalized linker molecule. For example, a functionalized saccharide molecule may be chemically modified to contain multiple chemical reactive groups (SH—, $NH_2$—, $N_3$, etc. . . . ) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated chimeric polynucleotides and/or IVT polynucleotides.

In one embodiment, the chimeric polynucleotides and/or IVT polynucleotides may be linked together in a pattern. The pattern may be a simple alternating pattern such as $CD[CD]_x$ where each "C" and each "D" represent a chimeric polynucleotide, IVT polynucleotide, different chimeric polynucleotides or different IVT polynucleotides. The pattern may repeat x number of times, where x=1-300. It is to be understood that the antigens of the NAVs of the present invention may be encoded by such linked polynucleotides, as described herein. Paterns may also be alternating multiples such as $CCDD[CCDD]_x$ (an alternating double multiple) or $CCCDDD[CCCDDD]_x$ (an alternating triple multiple) pattern. The alternating double multiple or alternating triple multiple may repeat x number of times, where x=1-300.

Conjugates and Combinations of Polynucleotides

In order to further enhance protein production, polynucleotides of the present invention can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

In a preferred embodiment, the polynucleotides of the present invention which encode an antigen are conjugated to one or more dendritic cell markers.

Conjugation may result in increased stability and/or half life and may be particularly useful in targeting the polynucleotides to specific sites in the cell, tissue or organism.

According to the present invention, the polynucleotides may be administered with, conjugated to or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

Bifunctional Polynucleotides

In one embodiment of the invention NAVs may comprise bifunctional polynucleotides (e.g., bifunctional IVT polynucleotides, bifunctional chimeric polynucleotides or bifunctional circular polynucleotides). As the name implies, bifunctional polynucleotides are those having or capable of at least two functions. These molecules may also by convention be referred to as multi-functional. It is to be understood that the NAV polynucleotides of the present invention may be conjugated to other molecules or agents, as described supra.

The multiple functionalities of bifunctional polynucleotides may be encoded by the NAV (the function may not manifest until the encoded product is translated) or may be a property of the polynucleotide itself. It may be structural or chemical. Bifunctional modified polynucleotides may comprise a function that is covalently or electrostatically associated with the polynucleotides. Further, the two functions may be provided in the context of a complex of a chimeric polynucleotide and another molecule.

Noncoding Polynucleotides

As described herein, provided are polynucleotides having sequences that are partially or substantially not translatable, e.g., having a noncoding region. As one non-limiting example, the noncoding region may be the first region of the IVT polynucleotide or the circular polynucleotide. Alternatively, the noncoding region may be a region other than the first region. As another non-limiting example, the noncoding region may be the A, B and/or C region of the chimeric polynucleotide.

Such molecules are generally not translated, but can exert an effect on the immune response or protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The polynucleotide may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA). Examples of such lncRNA molecules and RNAi constructs designed to target such lncRNA any of which may be encoded in the polynucleotides are taught in International Publication, WO2012/018881 A2, the contents of which are incorporated herein by reference in their entirety.

According to the present invention, the polynucleotide may be designed to encode one or more polypeptides of interest or fragments thereof. Such polypeptide of interest may include, but is not limited to, whole polypeptides, a plurality of polypeptides or fragments of polypeptides, which independently may be encoded by one or more regions or parts or the whole of a polynucleotide. As used herein, the term "polypeptides of interest" refer to any polypeptide which is selected to be encoded within, or whose function is affected by, the polynucleotides of the present invention. Any of the peptides or polypeptides of the invention may be antigenic.

As used herein, "polypeptide" means a polymer of amino acid residues (natural or unnatural) linked together most often by peptide bonds. The term, as used herein, refers to proteins, polypeptides, and peptides of any size, structure, or function. In one embodiment, the polypeptides of interest are antigens encoded by the polynucleotides as described herein.

In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this invention. For example, sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the polynucleotides of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biol 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by a polynucleotide of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis or a priori incorporation during chemical synthesis. The resulting modified molecules may then be tested for activity using in vitro or in vivo assays such as those described herein or any other suitable screening assay known in the art.

According to the present invention, the polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of polypeptides of interest of this invention. For example, provided herein is any protein fragment (meaning a polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

In one embodiment, at least one polypeptide of interest may be an antigen or fragment thereof, or any component of a ribonucleic acid vaccine.

Reference molecules (polypeptides or polynucleotides) may share a certain identity with the designed molecules (polypeptides or polynucleotides). The term "identity" as known in the art, refers to a relationship between the sequences of two or more peptides, polypeptides or polynucleotides, as determined by comparing the sequences. In the art, identity also means the degree of sequence relatedness between them as determined by the number of matches between strings of two or more amino acid residues or nucleosides. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the encoded polypeptide variant may have the same or a similar activity as the reference polypeptide. Alternatively, the variant may have an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "Identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., *Homo sapiens*.

Cell-Penetrating Polypeptides

The polynucleotides disclosed herein (e.g., antigen-encoding polynucleotides featured in the NAVs of the invention), may also encode one or more cell-penetrating polypeptides. As used herein, "cell-penetrating polypeptide" or CPP refers to a polypeptide which may facilitate the cellular uptake of molecules. A cell-penetrating polypeptide of the present invention may contain one or more detectable labels. The polypeptides may be partially labeled or completely labeled throughout. The polynucleotides may encode the detectable label completely, partially or not at all. The cell-penetrating peptide may also include a signal sequence. As used herein, a "signal sequence" refers to a sequence of amino acid residues bound at the amino terminus of a nascent protein during protein translation. The signal sequence may be used to signal the secretion of the cell-penetrating polypeptide.

In one embodiment, the polynucleotides may also encode a fusion protein. The fusion protein may be created by operably linking a charged protein to a therapeutic protein. As used herein, "operably linked" refers to the therapeutic protein and the charged protein being connected in such a way to permit the expression of the complex when introduced into the cell. As used herein, "charged protein" refers to a protein that carries a positive, negative or overall neutral electrical charge. Preferably, the therapeutic protein may be covalently linked to the charged protein in the formation of the fusion protein. The ratio of surface charge to total or surface amino acids may be approximately 0.1, 0.2, 0.3, 0.4, 0.5, 0.6, 0.7, 0.8 or 0.9.

The cell-penetrating polypeptide encoded by the polynucleotides may form a complex after being translated. The complex may comprise a charged protein linked, e.g. covalently linked, to the cell-penetrating polypeptide. "Therapeutic protein" refers to a protein that, when administered to a cell has a therapeutic, diagnostic, and/or prophylactic effect and/or elicits a desired biological and/or pharmacological effect.

In one embodiment, the cell-penetrating polypeptide may comprise a first domain and a second domain. The first domain may comprise a supercharged polypeptide. The second domain may comprise a protein-binding partner. As used herein, "protein-binding partner" includes, but is not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the polynucleotides may be introduced. The cell-penetrating polypeptide may also be capable of penetrating the first cell.

In a further embodiment, the cell-penetrating polypeptide is capable of penetrating a second cell. The second cell may be from the same area as the first cell, or it may be from a different area. The area may include, but is not limited to, tissues and organs. The second cell may also be proximal or distal to the first cell.

In one embodiment, the polynucleotides may encode a cell-penetrating polypeptide which may comprise a protein-binding partner. The protein binding partner may include, but is not limited to, an antibody, a supercharged antibody or a functional fragment. The polynucleotides may be introduced into the cell where a cell-penetrating polypeptide comprising the protein-binding partner is introduced.

Anti-Microbial and Anti-Viral Polypeptides

The polynucleotides of the present invention (e.g., antigen-encoding polynucleotides featured in the NAVs of the invention) may be designed to encode, or be co-administered with, a polynucleotide encoding one or more antimicrobial peptides (AMP) or antiviral peptides (AVP). AMPs and AVPs have been isolated and described from a wide range of animals such as, but not limited to, microorganisms, invertebrates, plants, amphibians, birds, fish, and mammals (Wang et al., *Nucleic Acids Res.* 2009; 37 (Database issue): D933-7). For example, anti-microbial polypeptides are described in Antimicrobial Peptide Database (http://aps.unmc.edu/AP/main.php; Wang et al., *Nucleic Acids Res.* 2009; 37 (Database issue):D933-7), CAMP: Collection of Anti-Microbial Peptides (http://www.bicnirrh.res.in/antimicrobial/); Thomas et al., *Nucleic Acids Res.* 2010; 38 (Database issue):D774-80), U.S. Pat. No. 5,221,732, U.S. Pat. No. 5,447,914, U.S. Pat. No. 5,519,115, U.S. Pat. No. 5,607,914, U.S. Pat. No. 5,714,577, U.S. Pat. No. 5,734,015, U.S. Pat. No. 5,798,336, U.S. Pat. No. 5,821,224, U.S. Pat. No. 5,849,490, U.S. Pat. No. 5,856,127, U.S. Pat. No. 5,905,187, U.S. Pat. No. 5,994,308, U.S. Pat. No. 5,998,374, U.S. Pat. No. 6,107,460, U.S. Pat. No. 6,191,254, U.S. Pat. No. 6,211,148, U.S. Pat. No. 6,300,489, U.S. Pat. No. 6,329,504, U.S. Pat. No. 6,399,370, U.S. Pat. No. 6,476,189, U.S. Pat. No. 6,478,825, U.S. Pat. No. 6,492,328, U.S. Pat. No. 6,514,701, U.S. Pat. No. 6,573,361, U.S. Pat. No. 6,573,361, U.S. Pat. No. 6,576,755, U.S. Pat. No. 6,605,698, U.S. Pat. No. 6,624,140, U.S. Pat. No. 6,638,531, U.S. Pat. No. 6,642,203, U.S. Pat. No. 6,653,280, U.S. Pat. No. 6,696,238, U.S. Pat. No. 6,727,066, U.S. Pat. No. 6,730,659, U.S. Pat. No. 6,743,598, U.S. Pat. No. 6,743,769, U.S. Pat. No. 6,747,007, U.S. Pat. No. 6,790,833, U.S. Pat. No. 6,794,490, U.S. Pat. No. 6,818,407, U.S. Pat. No. 6,835,536, U.S. Pat. No. 6,835,713, U.S. Pat. No. 6,838,435, U.S. Pat. No. 6,872,705, U.S. Pat. No. 6,875,907, U.S. Pat. No. 6,884,776, U.S. Pat. No. 6,887,847, U.S. Pat. No. 6,906,035, U.S. Pat. No. 6,911,524, U.S. Pat. No. 6,936,432, U.S. Pat. No. 7,001,924, U.S. Pat. No. 7,071,293, U.S. Pat. No. 7,078,380, U.S. Pat. No. 7,091,185, U.S. Pat. No. 7,094,759, U.S. Pat. No. 7,166,769, U.S. Pat. No. 7,244,710, U.S. Pat. No. 7,314,858, and U.S. Pat. No. 7,582,301, the contents of which are incorporated by reference in their entirety.

The anti-microbial polypeptides described herein may block cell fusion and/or viral entry by one or more enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the transmembrane subunit of a viral envelope protein, e.g., HIV-1 gp120 or gp41. The amino acid and nucleotide sequences of HIV-1 gp120 or gp41 are described in, e.g., Kuiken et al., (2008). "*HIV Sequence Compendium,*" *Los Alamos National Laboratory.*

In some embodiments, the anti-microbial polypeptide may have at least about 75%, 80%, 85%, 90%, 95%, 100% sequence homology to the corresponding viral protein sequence. In some embodiments, the anti-microbial polypeptide may have at least about 75%, 80%, 85%, 90%, 95%, or 100% sequence homology to the corresponding viral protein sequence.

In other embodiments, the anti-microbial polypeptide may comprise or consist of a synthetic peptide corresponding to a region, e.g., a consecutive sequence of at least about 5, 10, 15, 20, 25, 30, 35, 40, 45, 50, 55, or 60 amino acids of the binding domain of a capsid binding protein. In some embodiments, the anti-microbial polypeptide may have at least about 75%, 80%, 85%, 90%, 95%, or 100% sequence homology to the corresponding sequence of the capsid binding protein.

The anti-microbial polypeptides described herein may block protease dimerization and inhibit cleavage of viral proproteins (e.g., HIV Gag-pol processing) into functional proteins thereby preventing release of one or more enveloped viruses (e.g., HIV, HCV). In some embodiments, the anti-microbial polypeptide may have at least about 75%, 80%, 85%, 90%, 95%, 100% sequence homology to the corresponding viral protein sequence.

In other embodiments, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the binding domain of a protease binding protein. In some embodiments, the anti-microbial polypeptide may have at least about 75%, 80%, 85%, 90%, 95%, 100% sequence homology to the corresponding sequence of the protease binding protein.

The anti-microbial polypeptides described herein can include an in vitro-evolved polypeptide directed against a viral pathogen.

Anti-Microbial Polypeptides

Anti-microbial polypeptides (AMPs) are small peptides of variable length, sequence and structure with broad spectrum activity against a wide range of microorganisms including, but not limited to, bacteria, viruses, fungi, protozoa, parasites, prions, and tumor/cancer cells. (See, e.g., Zaiou, J Mol Med, 2007; 85:317; herein incorporated by reference in its entirety). It has been shown that AMPs have broad-spectrum of rapid onset of killing activities, with potentially low levels of induced resistance and concomitant broad anti-inflammatory effects.

In some embodiments, the anti-microbial polypeptide (e.g., an anti-bacterial polypeptide) may be under 10 kDa, e.g., under 8 kDa, 6 kDa, 4 kDa, 2 kDa, or 1 kDa. In some embodiments, the anti-microbial polypeptide (e.g., an anti-bacterial polypeptide) consists of from about 6 to about 100 amino acids, e.g., from about 6 to about 75 amino acids, about 6 to about 50 amino acids, about 6 to about 25 amino acids, about 25 to about 100 amino acids, about 50 to about 100 amino acids, or about 75 to about 100 amino acids. In certain embodiments, the anti-microbial polypeptide (e.g., an anti-bacterial polypeptide) may consist of from about 15 to about 45 amino acids. In some embodiments, the anti-microbial polypeptide (e.g., an anti-bacterial polypeptide) is substantially cationic.

In some embodiments, the anti-microbial polypeptide (e.g., an anti-bacterial polypeptide) may be substantially amphipathic. In certain embodiments, the anti-microbial polypeptide (e.g., an anti-bacterial polypeptide) may be substantially cationic and amphipathic. In some embodiments, the anti-microbial polypeptide (e.g., an anti-bacterial polypeptide) may be cytostatic to a Gram-positive bacterium. In some embodiments, the anti-microbial polypeptide (e.g., an anti-bacterial polypeptide) may be cytotoxic to a Gram-positive bacterium. In some embodiments, the anti-microbial polypeptide (e.g., an anti-bacterial polypeptide) may be cytostatic and cytotoxic to a Gram-positive bacterium. In some embodiments, the anti-microbial polypeptide (e.g., an anti-bacterial polypeptide) may be cytostatic to a Gram-negative bacterium. In some embodiments, the anti-microbial polypeptide (e.g., an anti-bacterial polypeptide) may be cytotoxic to a Gram-negative bacterium. In some embodiments, the anti-microbial polypeptide (e.g., an anti-bacterial polypeptide) may be cytostatic and cytotoxic to a Gram-positive bacterium. In some embodiments, the anti-microbial polypeptide may be cytostatic to a virus, fungus, protozoan, parasite, prion, or a combination thereof. In some embodiments, the anti-microbial polypeptide may be cytotoxic to a virus, fungus, protozoan, parasite, prion, or a combination thereof. In certain embodiments, the anti-microbial polypeptide may be cytostatic and cytotoxic to a virus, fungus, protozoan, parasite, prion, or a combination thereof. In some embodiments, the anti-microbial polypeptide may be cytotoxic to a tumor or cancer cell (e.g., a human tumor and/or cancer cell). In some embodiments, the anti-microbial polypeptide may be cytostatic to a tumor or cancer cell (e.g., a human tumor and/or cancer cell). In certain embodiments, the anti-microbial polypeptide may be cytotoxic and cytostatic to a tumor or cancer cell (e.g., a human tumor or cancer cell). In some embodiments, the anti-microbial polypeptide (e.g., an anti-bacterial polypeptide) may be a secreted polypeptide.

In some embodiments, the anti-microbial polypeptide comprises or consists of a defensin. Exemplary defensins include, but are not limited to, α-defensins (e.g., neutrophil defensin 1, defensin alpha 1, neutrophil defensin 3, neutrophil defensin 4, defensin 5, defensin 6), β-defensins (e.g., beta-defensin 1, beta-defensin 2, beta-defensin 103, beta-defensin 107, beta-defensin 110, beta-defensin 136), and θ-defensins. In other embodiments, the anti-microbial polypeptide comprises or consists of a cathelicidin (e.g., hCAP18).

Anti-Viral Polypeptides

Anti-viral polypeptides (AVPs) are small peptides of variable length, sequence and structure with broad spectrum activity against a wide range of viruses. See, e.g., Zaiou, J Mol Med, 2007; 85:317. It has been shown that AVPs have a broad-spectrum of rapid onset of killing activities, with potentially low levels of induced resistance and concomitant broad anti-inflammatory effects. In some embodiments, the anti-viral polypeptide is under 10 kDa, e.g., under 8 kDa, 6 kDa, 4 kDa, 2 kDa, or 1 kDa. In some embodiments, the anti-viral polypeptide comprises or consists of from about 6 to about 100 amino acids, e.g., from about 6 to about 75 amino acids, about 6 to about 50 amino acids, about 6 to about 25 amino acids, about 25 to about 100 amino acids, about 50 to about 100 amino acids, or about 75 to about 100 amino acids. In certain embodiments, the anti-viral polypeptide comprises or consists of from about 15 to about 45 amino acids. In some embodiments, the anti-viral polypeptide is substantially cationic. In some embodiments, the anti-viral polypeptide is substantially amphipathic. In certain embodiments, the anti-viral polypeptide is substantially cationic and amphipathic. In some embodiments, the anti-viral polypeptide is cytostatic to a virus. In some embodiments, the anti-viral polypeptide is cytotoxic to a virus. In some embodiments, the anti-viral polypeptide is cytostatic and cytotoxic to a virus. In some embodiments, the anti-viral polypeptide is cytostatic to a bacterium, fungus, protozoan, parasite, prion, or a combination thereof. In some embodiments, the anti-viral polypeptide is cytotoxic to a bacterium, fungus, protozoan, parasite, prion or a combination thereof. In certain embodiments, the anti-viral polypeptide is cytostatic and cytotoxic to a bacterium, fungus, protozoan, parasite, prion, or a combination thereof. In some embodiments, the anti-viral polypeptide is cytotoxic to a tumor or cancer cell (e.g., a human cancer cell). In some embodiments, the anti-viral polypeptide is cytostatic to a tumor or cancer cell (e.g., a human cancer cell). In certain embodiments, the anti-viral polypeptide is cytotoxic and cytostatic to a tumor or cancer cell (e.g., a human cancer cell). In some embodiments, the anti-viral polypeptide is a secreted polypeptide.

Cytotoxic Nucleosides

In one embodiment, the polynucleotides of the present invention (e.g., antigen-encoding polynucleotides featured in the NAVs of the invention) may incorporate one or more cytotoxic nucleosides. For example, cytotoxic nucleosides may be incorporated into polynucleotides such as bifunctional modified RNAs or mRNAs. Cytotoxic nucleoside anti-cancer agents include, but are not limited to, adenosine arabinoside, cytarabine, cytosine arabinoside, 5-fluorouracil, fludarabine, floxuridine, FTORAFUR® (a combination of tegafur and uracil), tegafur ((RS)-5-fluoro-1-(tetrahydrofuran-2-yl)pyrimidine-2,4(1H,3H)-dione), and 6-mercaptopurine.

A number of cytotoxic nucleoside analogues are in clinical use, or have been the subject of clinical trials, as anticancer agents. Examples of such analogues include, but are not limited to, cytarabine, gemcitabine, troxacitabine, decitabine, tezacitabine, 2'-deoxy-2'-methylidenecytidine (DMDC), cladribine, clofarabine, 5-azacytidine, 4'-thio-ara-cytidine, cyclopentenylcytosine and 1-(2-C-cyano-2-deoxy-beta-D-arabino-pentofuranosyl)-cytosine. Another example of such a compound is fludarabine phosphate. These compounds may be administered systemically and may have side effects which are typical of cytotoxic agents such as, but not limited to, little or no specificity for tumor cells over proliferating normal cells.

A number of prodrugs of cytotoxic nucleoside analogues are also reported in the art. Examples include, but are not limited to, N4-behenoyl-1-beta-D-arabinofuranosylcytosine, N4-octadecyl-1-beta-D-arabinofuranosylcytosine, N4-palmitoyl-1-(2-C-cyano-2-deoxy-beta-D-arabino-pentofuranosyl) cytosine, and P-4055 (cytarabine 5'-elaidic acid ester). In general, these prodrugs may be converted into the active drugs mainly in the liver and systemic circulation and display little or no selective release of active drug in the tumor tissue. For example, capecitabine, a prodrug of 5'-deoxy-5-fluorocytidine (and eventually of 5-fluorouracil), is metabolized both in the liver and in the tumor tissue. A series of capecitabine analogues containing "an easily hydrolysable radical under physiological conditions" has been claimed by Fujiu et al. (U.S. Pat. No. 4,966,891) and is herein incorporated by reference. The series described by Fujiu includes N4 alkyl and aralkyl carbamates of 5'-deoxy-5-fluorocytidine and the implication that these compounds will be activated by hydrolysis under normal physiological conditions to provide 5'-deoxy-5-fluorocytidine.

A series of cytarabine N4-carbamates has been by reported by Fadl et al (Pharmazie. 1995, 50, 382-7, herein incorporated by reference in its entirety) in which compounds were designed to convert into cytarabine in the liver and plasma. WO 2004/041203, herein incorporated by reference in its entirety, discloses prodrugs of gemcitabine, where some of the prodrugs are N4-carbamates. These compounds were designed to overcome the gastrointestinal toxicity of gemcitabine and were intended to provide gemcitabine by hydrolytic release in the liver and plasma after absorption of the intact prodrug from the gastrointestinal tract. Nomura et al (Bioorg Med. Chem. 2003, 11, 2453-61, herein incorporated by reference in its entirety) have described acetal derivatives of 1-(3-C-ethynyl-β-D-ribopentofaranosyl) cytosine which, on bioreduction, produced an intermediate that required further hydrolysis under acidic conditions to produce a cytotoxic nucleoside compound.

Cytotoxic nucleotides which may be chemotherapeutic also include, but are not limited to, pyrazolo [3,4-D]-pyrimidines, allopurinol, azathioprine, capecitabine, cytosine arabinoside, fluorouracil, mercaptopurine, 6-thioguanine, acyclovir, ara-adenosine, ribavirin, 7-deaza-adeno sine, 7-deaza-guanosine, 6-aza-uracil, 6-aza-cytidine, thymidine ribonucleotide, 5-bromodeoxyuridine, 2-chloro-purine, and inosine, or combinations thereof.

Polynucleotides having Untranslated Regions (UTRs)

The polynucleotides of the present invention (e.g., antigen-encoding polynucleotides featured in the NAVs of the invention) may comprise one or more regions or parts which act or function as an untranslated region. Where polynucleotides are designed to encode at least one polypeptide of interest, the polynucleotides may comprise one or more of these untranslated regions.

By definition, wild type untranslated regions (UTRs) of a gene are transcribed but not translated. In mRNA, the 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the polynucleotides of the present invention to, among other things, enhance the stability of the molecule. The specific features can also be incorporated to ensure controlled down-regulation of the transcript in case they are misdirected to undesired organs sites.

Tables 19 and 20 provide a listing of exemplary UTRs which may be utilized in the polynucleotides of the present invention. Shown in Table 19 is a listing of a 5'-untranslated region of the invention. Variants of 5' UTRs may be utilized wherein one or more nucleotides are added or removed to the termini, including A, T, C or G.

TABLE 19

5'-Untranslated Regions

| 5' UTR Identifier | Name/ Description | Sequence | SEQ ID NO. |
|---|---|---|---|
| 5UTR-001 | Upstream UTR | GGGAAATAAGAGAGAAAAGAAGAGTAAGAAG AAATATAAGAGCCACC | 897 |
| 5UTR-002 | Upstream UTR | GGGAGATCAGAGAGAAAAGAAGAGTAAGAAG AAATATAAGAGCCACC | 898 |
| 5UTR-003 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 899 |
| 5UTR-004 | Upstream UTR | GGGAGACAAGCUUGGCAUUCCGGUACUGUUG GUAAAGCCACC | 900 |
| 5UTR-005 | Upstream UTR | GGGAGATCAGAGAGAAAAGAAGAGTAAGAAG AAATATAAGAGCCACC | 901 |
| 5UTR-006 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 902 |
| 5UTR-007 | Upstream UTR | GGGAGACAAGCUUGGCAUUCCGGUACUGUUG GUAAAGCCACC | 903 |
| 5UTR-008 | Upstream UTR | GGGAATTAACAGAGAAAAGAAGAGTAAGAAG AAATATAAGAGCCACC | 904 |
| 5UTR-009 | Upstream UTR | GGGAAATTAGACAGAAAAGAAGAGTAAGAAG AAATATAAGAGCCACC | 905 |
| 5UTR-010 | Upstream UTR | GGGAAATAAGAGAGTAAAGAACAGTAAGAAG AAATATAAGAGCCACC | 906 |
| 5UTR-011 | Upstream UTR | GGGAAAAAGAGAGAAAAGAAGACTAAGAAG AAATATAAGAGCCACC | 907 |
| 5UTR-012 | Upstream UTR | GGGAAATAAGAGAGAAAAGAAGAGTAAGAAG ATATATAAGAGCCACC | 908 |
| 5UTR-013 | Upstream UTR | GGGAAATAAGAGACAAAACAAGAGTAAGAAG AAATATAAGAGCCACC | 909 |
| 5UTR-014 | Upstream UTR | GGGAAATTAGAGAGTAAAGAACAGTAAGTAG AATTAAAAGAGCCACC | 910 |
| 5UTR-015 | Upstream UTR | GGGAAATAAGAGAGAATAGAAGAGTAAGAAG AAATATAAGAGCCACC | 911 |
| 5UTR-016 | Upstream UTR | GGGAAATAAGAGAGAAAAGAAGAGTAAGAAG AAAATTAAGAGCCACC | 912 |

TABLE 19-continued

5'-Untranslated Regions

| 5' UTR Identifier | Name/ Description | Sequence | SEQ ID NO. |
|---|---|---|---|
| 5UTR-017 | Upstream UTR | GGGAAATAAGAGAGAAAAGAAGAGTAAGAAG AAATTTAAGAGCCACC | 913 |

Shown in Table 20 is a listing of 3'-untranslated regions of the invention. Variants of 3' UTRs may be utilized wherein one or more nucleotides are added or removed to the termini, including A, T, C or G.

TABLE 20

3'-Untranslated Regions

| 3' UTR Identifier | Name/ Description | Sequence | SEQ ID NO. |
|---|---|---|---|
| 3UTR-001 | Creatine Kinase | GCGCCTGCCCACCTGCCACCGACTGCTGGAACCCAGC CAGTGGGAGGGCCTGGCCCACCAGAGTCCTGCTCCCT CACTCCTCGCCCCGCCCCTGTCCCAGAGTCCCACCTG GGGGCTCTCTCCACCCTTCTCAGAGTTCCAGTTTCAAC CAGAGTTCCAACCAATGGGCTCCATCCTCTGGATTCTG GCCAATGAAATATCTCCCTGGCAGGGTCCTCTTCTTTT CCCAGAGCTCCACCCCAACCAGGAGCTCTAGTTAATG GAGAGCTCCCAGCACACTCGGAGCTTGTGCTTTGTCTC CACGCAAAGCGATAAATAAAAGCATTGGTGGCCTTTG GTCTTTGAATAAAGCCTGAGTAGGAAGTCTAGA | 914 |
| 3UTR-002 | Myoglobin | GCCCCTGCCGCTCCCACCCCCACCCATCTGGGCCCCGG GTTCAAGAGAGAGCGGGGTCTGATCTCGTGTAGCCAT ATAGAGTTTGCTTCTGAGTGTCTGCTTTGTTTAGTAGA GGTGGGCAGGAGGAGCTGAGGGGCTGGGGCTGGGGT GTTGAAGTTGGCTTTGCATGCCCAGCGATGCGCCTCCC TGTGGGATGTCATCACCCTGGGAACCGGGAGTGGCCC TTGGCTCACTGTGTTCTGCATGGTTTGGATCTGAATTA ATTGTCCTTTCTTCTAAATCCCAACCGAACTTCTTCCA ACCTCCAAACTGGCTGTAACCCCAAATCCAAGCCATT AACTACACCTGACAGTAGCAATTGTCTGATTAATCACT GGCCCCTTGAAGACAGCAGAATGTCCCTTTGCAATGA GGAGGAGATCTGGGCTGGGCGGGCCAGCTGGGGAAG CATTTGACTATCTGGAACTTGTGTGTGCCTCCTCAGGT ATGGCAGTGACTCACCTGGTTTTAATAAAACAACCTG CAACATCTCATGGTCTTTGAATAAAGCCTGAGTAGGA AGTCTAGA | 915 |
| 3UTR-003 | α-actin | ACACACTCCACCTCCAGCACGCGACTTCTCAGGACGA CGAATCTTCTCAATGGGGGGGCGGCTGAGCTCCAGCC ACCCCGCAGTCACTTTCTTTGTAACAACTTCCGTTGCT GCCATCGTAAACTGACACAGTGTTTATAACGTGTACAT ACATTAACTTATTACCTCATTTTGTTATTTTTCGAAACA AAGCCCTGTGGAAGAAAATGGAAAACTTGAAGAAGC ATTAAAGTCATTCTGTTAAGCTGCGTAAATGGTCTTTG AATAAAGCCTGAGTAGGAAGTCTAGA | 916 |
| 3UTR-004 | Albumin | CATCACATTTAAAAGCATCTCAGCCTACCATGAGAAT AAGAGAAAGAAAATGAAGATCAAAAGCTTATTCATCT GTTTTTCTTTTTCGTTGGTGTAAAGCCAACACCCTGTCT AAAAAACATAAATTTCTTTAATCATTTTGCCTCTTTTCT CTGTGCTTCAATTAATAAAAAATGGAAAGAATCTAAT AGAGTGGTACAGCACTGTTATTTTTCAAAGATGTGTTG CTATCCTGAAAATTCTGTAGGTTCTGTGGAAGTTCCAG TGTTCTCTCTTATTCCACTTCGGTAGAGGATTTCTAGTT TCTTGTGGGCTAATTAAATAAATCATTAATACTCTTCT AATGGTCTTTGAATAAAGCCTGAGTAGGAAGTCTAGA | 917 |
| 3UTR-005 | α-globin | GCTGCCTTCTGCGGGGCTTGCCTTCTGGCCATGCCCTT CTTCTCTCCCTTGCACCTGTACCTCTTGGTCTTTGAATA AAGCCTGAGTAGGAAGGCGGCCGCTCGAGCATGCATC TAGA | 918 |
| 3UTR-006 | G-CSF | GCCAAGCCCTCCCCATCCCATGTATTTATCTCTATTTA ATATTTATGTCTATTTAAGCCTCATATTTAAAGACAGG GAAGAGCAGAACGGAGCCCCAGGCCTCTGTGTCCTTC CCTGCATTTCTGAGTTTCATTCTCCTGCCCTGTAGCAGT GAGAAAAAGCTCCTGTCCTCCCATCCCCTGGACTGGG AGGTAGATAGGTAAATACCAAGTATTTATTACTATGA | 919 |

TABLE 20-continued

3'-Untranslated Regions

| 3' UTR Identifier | Name/ Description | Sequence | SEQ ID NO. |
|---|---|---|---|
| | | CTGCTCCCCAGCCCTGGCTCTGCAATGGGCACTGGGAT GAGCCGCTGTGAGCCCTGGTCCTGAGGGTCCCCACC TGGGACCCTTGAGAGTATCAGGTCTCCCACGTGGGAG ACAAGAAATCCCTGTTTAATATTTAAACAGCAGTGTTC CCCATCTGGGTCCTTGCACCCCTCACTCTGGCCTCAGC CGACTGCACAGCGGCCCCTGCATCCCCTTGGCTGTGA GGCCCCTGGACAAGCAGAGGTGGCCAGAGCTGGGAG GCATGGCCCTGGGGTCCCACGAATTTGCTGGGGAATC TCGTTTTTCTTCTTAAGACTTTTGGGACATGGTTTGACT CCCGAACATCACCGACGCGTCCTGTTTTTCTGGGTG GCCTCGGGACACCTGCCCTGCCCCCACGAGGGTCAGG ACTGTGACTCTTTTTAGGGCCAGGCAGGTGCCTGGAC ATTTGCCTTGCTGGACGGGGACTGGGGATGTGGGAGG GAGCAGACAGGAGGAATCATGTCAGGCCTGTGTGTGA AAGGAAGCTCCACTGTCACCCTCCACCTCTTCACCCCC CACTCACCAGTGTCCCCTCCACTGTCACATTGTAACTG AACTTCAGGATAATAAAGTGTTTGCCTCCATGGTCTTT GAATAAAGCCTGAGTAGGAAGGCGGCCGCTCGAGCAT GCATCTAGA | |
| 3UTR-007 | Col1a2; collagen, type I, alpha 2 | ACTCAATCTAAATTAAAAAAGAAAGAAATTTGAAAAA ACTTTCTCTTTGCCATTTCTTCTTCTTCTTTTTTAACTGA AAGCTGAATCCTTCCATTTCTTCTGCACATCTACTTGC TTAAATTGTGGGCAAAAGAGAAAAAGAAGGATTGATC AGAGCATTGTGCAATACAGTTTCATTAACTCCTTCCCC CGCTCCCCCAAAAATTTGAATTTTTTTTTCAACACTCTT ACACCTGTTATGGAAAATGTCAACCTTTGTAAGAAAA CCAAAATAAAAATTGAAAAATAAAAACCATAAACATT TGCACCACTTGTGGCTTTTGAATATCTTCCACAGAGGG AAGTTTAAAACCCAAACTTCCAAAGGTTTAAACTACC TCAAAACACTTTCCCATGAGTGTGATCCACATTGTTAG GTGCTGACCTAGACAGAGATGAACTGAGGTCCTTGTT TTGTTTTGTTCATAATACAAAGGTGCTAATTAATAGTA TTTCAGATACTTGAAGAATGTTGATGGTGCTAGAAGA ATTTGAGAAGAAATACTCCTGTATTGAGTTGTATCGTG TGGTGTATTTTTTAAAAAATTTGATTTAGCATTCATAT TTTCCATCTTATTCCCAATTAAAAGTATGCAGATTATT TGCCCAAATCTTCTTCAGATTCAGCATTTGTTCTTTGCC AGTCTCATTTTCATCTTCTTCCATGGTTCCACAGAAGC TTTGTTTCTTGGGCAAGCAGAAAAATTAAATTGTACCT ATTTTGTATATGTGAGATGTTTAAATAAATTGTGAAAA AAATGAAATAAAGCATGTTTGGTTTTCCAAAAGAACA TAT | 920 |
| 3UTR-008 | Col6a2; collagen, type VI, alpha 2 | CGCCGCCGCCCGGGCCCCGCAGTCGAGGGTCGTGAGC CCACCCCGTCCATGGTGCTAAGCGGGCCCGGGTCCCA CACGGCCAGCACCGCTGCTCACTCGGACGACGCCCTG GGCCTGCACCTCTCCAGCTCCTCCCACGGGGTCCCCGT AGCCCCGGCCCCGCCCAGCCCCAGGTCTCCCCAGGC CCTCCGCAGGCTGCCCGGCCTCCCTCCCCCTGCAGCCA TCCCAAGGCTCCTGACCTACCTGGCCCCTGAGCTCTGG AGCAAGCCCTGACCCAATAAAGGCTTTGAACCCAT | 921 |
| 3UTR-009 | RPN1; ribophorin I | GGGGCTAGAGCCCTCTCCGCACAGCGTGGAGACGGGG CAAGGAGGGGGGTTATTAGGATTGGTGGTTTTGTTTTG CTTTGTTTAAAGCCGTGGGAAAATGGCACAACTTTACC TCTGTGGGAGATGCAACACTGAGAGCCAAGGGGTGGG AGTTGGGATAATTTTTATATAAAAGAAGTTTTTCCACT TTGAATTGCTAAAAGTGGCATTTTTCCTATGTGCAGTC ACTCCTCTCATTTCTAAAATAGGGACGTGGCCAGGCA CGGTGGCTCATGCCTGTAATCCCAGCACTTTGGGAGG CCGAGGCAGGCGGCTCACGAGGTCAGGAGATCGAGA CTATCCTGGCTAACACGGTGAAAACCCGTCTCTACTAA AAGTACAAAAAATTAGCTGGGCGTGGTGGTGGGCACC TGTAGTCCCAGCTACTCGGGAGGCTGAGGCAGGAGAA AGGCATGAATCCAAGAGGCAGAGCTTGCAGTGAGCTG AGATCACGCCATTGCACTCCAGCCTGGGCAACAGTGT TAAGACTCTGTCTCAAATATAAATAAATAATAAATA AATAAATAAATAAATAAAAATAAAGCGAGATGTTGCC CTCAAA | 922 |

TABLE 20-continued

3'-Untranslated Regions

| 3' UTR Identifier | Name/ Description | Sequence | SEQ ID NO. |
|---|---|---|---|
| 3UTR-010 | LRP1; low density lipoprotein receptor-related protein 1 | GGCCCTGCCCCGTCGGACTGCCCCCAGAAAGCCTCCT GCCCCCTGCCAGTGAAGTCCTTCAGTGAGCCCCTCCCC AGCCAGCCCTTCCCTGGCCCCGCCGGATGTATAAATGT AAAAATGAAGGAATTACATTTTATATGTGAGCGAGCA AGCCGGCAAGCGAGCACAGTATTATTTCTCCATCCCCT CCCTGCCTGCTCCTTGGCACCCCCATGCTGCCTTCAGG GAGACAGGCAGGGAGGGCTTGGGGCTGCACCTCCTAC CCTCCCACCAGAACGCACCCCACTGGGAGAGCTGGTG GTGCAGCCTTCCCCTCCCTGTATAAGACACTTTGCCAA GGCTCTCCCCTCTCGCCCCATCCCTGCTTGCCCGCTCC CACAGCTTCCTGAGGGCTAATTCTGGGAAGGGAGAGT TCTTTGCTGCCCCTGTCTGGAAGACGTGGCTCTGGGTG AGGTAGGCGGGAAAGGATGGAGTGTTTTAGTTCTTGG GGGAGGCCACCCCAAACCCCAGCCCCAACTCCAGGGG CACCTATGAGATGGCCATGCTCAACCCCCCTCCCAGA CAGGCCCTCCCTGTCTCCAGGGCCCCCACCGAGGTTCC CAGGGCTGGAGACTTCCTCTGGTAAACATTCCTCCAGC CTCCCCTCCCCTGGGGACGCCAAGGAGGTGGGCCACA CCCAGGAAGGGAAAGCGGGCAGCCCCGTTTTGGGGAC GTGAACGTTTTAATAATTTTGCTGAATTCCTTTACAA CTAAATAACACAGATATTGTTATAAATAAAATTGT | 923 |
| 3UTR-011 | Nnt1; cardio-trophin-like cytokine factor 1 | ATATTAAGGATCAAGCTGTTAGCTAATAATGCCACCTC TGCAGTTTTGGGAACAGGCAAATAAAGTATCAGTATA CATGGTGATGTACATCTGTAGCAAAGCTCTTGGAGAA AATGAAGACTGAAGAAAGCAAAGCAAAACTGTATA GAGAGATTTTTCAAAAGCAGTAATCCCTCAATTTTAAA AAAGGATTGAAAATTCTAAATGTCTTTCTGTGCATATT TTTTGTGTTAGGAATCAAAAGTATTTTATAAAAGGAG AAAGAACAGCCTCATTTTAGATGTAGTCCTGTTGGATT TTTTATGCCTCCTCAGTAACCAGAAATGTTTTAAAAAA CTAAGTGTTTAGGATTTCAAGACAACATTATACATGGC TCTGAAATATCTGACACAATGTAAACATTGCAGGCAC CTGCATTTTATGTTTTTTTTTCAACAAATGTGACTAAT TTGAAACTTTTATGAACTTCTGAGCTGTCCCCTTGCAA TTCAACCGCAGTTTGAATTAATCATATCAAATCAGTTT TAATTTTTTAAATTGTACTTCAGAGTCTATATTTCAAG GGCACATTTTCTCACTACTATTTTAATACATTAAAGGA CTAAATAATCTTTCAGAGATGCTGGAAACAAATCATTT GCTTTATATGTTTCATTAGAATACCAATGAAACATACA ACTTGAAAATTAGTAATAGTATTTTTGAAGATCCCATT TCTAATTGGAGATCTCTTTAATTTCGATCAACTTATAA TGTGTAGTACTATATTAAGTGCACTTGAGTGGAATTCA ACATTTGACTAATAAAATGAGTTCATCATGTTGGCAA GTGATGTGGCAATTATCTCTGGTGACAAAAGAGTAAA ATCAAATATTTCTGCCTGTTACAAATATCAAGGAAGA CCTGCTACTATGAAATAGATGACATTAATCTGTCTTCA CTGTTTATAATACGGATGGATTTTTTTCAAATCAGTG TGTGTTTTGAGGTCTTATGTAATTGATGACATTTGAGA GAAATGGTGGCTTTTTTTAGCTACCTCTTTGTTCATTTA AGCACCAGTAAAGATCATGTCTTTTTATAGAAGTGTA GATTTTCTTTGTGACTTTGCTATCGTGCCTAAAGCTCT AAATATAGGTGAATGTGTGATGAATACTCAGATTATTT GTCTCTCTATATAATTAGTTTGGTACTAAGTTTCTCAA AAAATTATTAACACATGAAAGACAATCTCTAAACCAG AAAAAGAAGTAGTACAAATTTTGTTACTGTAATGCTC GCGTTTAGTGAGTTTAAAACACACAGTATCTTTTGGTT TTATAATCAGTTTCTATTTTGCTGTGCCTGAGATTAAG ATCTGTGTATGTGTGTGTGTGTGTGCGTTTGTGT GTTAAAGCAGAAAAGACTTTTTTAAAAGTTTTAAGTG ATAAATGCAATTTGTTAATTGATCTTAGATCACTAGTA AACTCAGGGCTGAATTATACCATGTATATTCTATTAGA AGAAAGTAAACACCATCTTTATTCCTGCCCTTTTTCTT CTCTCAAAGTAGTTGTAGTTATATCTAGAAAGAAGCA ATTTTGATTTCTTGAAAAGGTAGTTCCTGCACTCAGTT TAAACTAAAAATAATCATACTTGGATTTTATTTATTTT TGTCATAGTAAAAATTTTAATTTATATATATTTTTATTT AGTATTATCTTATTCTTTGCTATTTGCCAATCCTTTGTC ATCAATTGTGTTAAATGAATTGAAAATTCATGCCCTGT TCATTTTATTTTACTTTATTGGTTAGGATATTTAAAGG ATTTTTGTATATATAATTTCTTAAATTAATATTCCAAA AGGTTAGTGGACTTAGATTATAAATTATGGCAAAAAT CTAAAAACAACAAAAATGATTTTTATACATTCTATTTC ATTATTCCTCTTTTTTCCAATAAGTCATACAATTGGTAG ATATGACTTATTTTATTTTTGTATTATTCACTATATCTT | 924 |

TABLE 20-continued

3'-Untranslated Regions

| 3' UTR Identifier | Name/ Description | Sequence | SEQ ID NO. |
|---|---|---|---|
| | | TATGATATTTAAGTATAAATAATTAAAAAAATTTATTG TACCTTATAGTCTGTCACCAAAAAAAAAAAATTATCT GTAGGTAGTGAAATGCTAATGTTGATTTGTCTTTAAGG GCTTGTTAACTATCCTTTATTTTCTCATTTGTCTTAAAT TAGGAGTTTGTGTTTAAATTACTCATCTAAGCAAAAAA TGTATATAAATCCCATTACTGGGTATATACCCAAAGG ATTATAAATCATGCTGCTATAAAGACACATGCACACG TATGTTTATTGCAGCACTATTCACAATAGCAAAGACTT GGAACCAACCCAAATGTCCATCAATGATAGACTTGAT TAAGAAAATGTGCACATATACACCATGGAATACTATG CAGCCATAAAAAGGATGAGTTCATGTCCTTTGTAGG GACATGGATAAAGCTGGAAACCATCATTCTGAGCAAA CTATTGCAAGGACAGAAAACCAAACACTGCATGTTCT CACTCATAGGTGGGAATTGAACAATGAGAACACTTGG ACACAAGGTGGGGAACACCACACACCAGGGCCTGTCA TGGGGTGGGGGGAGTGGGGAGGGATAGCATTAGGAG ATATACCTAATGTAAATGATGAGTTAATGGGTGCAGC ACACCAACATGGCACATGTATACATATGTAGCAAACC TGCACGTTGTGCACATGTACCCTAGAACTTAAAGTATA ATTAAAAAAAAAAGAAAACAGAAGCTATTTATAAA GAAGTTATTTGCTGAAATAAATGTGATCTTTCCCATTA AAAAAATAAAGAAATTTTGGGGTAAAAAAACACAAT ATATTGTATTCTTGAAAAATTCTAAGAGAGTGGATGTG AAGTGTTCTCACCACAAAAGTGATAACTAATTGAGGT AATGCACATATTAATTAGAAAGATTTTGTCATTCCACA ATGTATATATACTTAAAAATATGTTATACACAATAAAT ACATACATTAAAAAATAAGTAAATGTA | |
| 3UTR-012 | Col6a1; collagen, type VI, alpha 1 | CCCACCCTGCACGCCGGCACCAAACCCTGTCCTCCCAC CCCTCCCCACTCATCACTAAACAGAGTAAAATGTGAT GCGAATTTTCCCGACCAACCTGATTCGCTAGATTTTTT TTAAGGAAAAGCTTGGAAAGCCAGGACACAACGCTGC TGCCTGCTTTGTGCAGGGTCCTCCGGGGCTCAGCCCTG AGTTGGCATCACCTGCGCAGGGCCCTCTGGGGCTCAG CCCTGAGCTAGTGTCACCTGCACAGGGCCCTCTGAGG CTCAGCCCTGAGCTGGCGTCACCTGTGCAGGGCCCTCT GGGGCTCAGCCCTGAGCTGGCCTCACCTGGGTTCCCC ACCCCGGGCTCTCCTGCCCTGCCCTCCTGCCCGCCCTC CCTCCTGCCTGCGCAGCTCCTTCCCTAGGCACCTCTGT GCTGCATCCCACCAGCCTGAGCAAGACGCCCTCTCGG GGCCTGTGCCGCACTAGCCTCCCTCTCCTCTGTCCCCA TAGCTGGTTTTTCCCACCAATCCTCACCTAACAGTTAC TTTACAATTAAACTCAAAGCAAGCTCTTCTCCTCAGCT TGGGGCAGCCATTGGCCTCTGTCTCGTTTTGGGAAACC AAGGTCAGGAGGCCGTTGCAGACATAAATCTCGGCGA CTCGGCCCCGTCTCCTGAGGGTCCTGCTGGTGACCGGC CTGGACCTTGGCCCTACAGCCCTGGAGGCCGCTGCTG ACCAGCACTGACCCCGACCTCAGAGAGTACTCGCAGG GGCGCTGGCTGCACTCAAGACCCTCGAGATTAACGGT GCTAACCCCGTCTGCTCCTCCCTCCCGCAGAGACTGGG GCCTGGACTGGACATGAGAGCCCCTTGGTGCCACAGA GGGCTGTGTCTTACTAGAAACAACGCAAACCTCTCCTT CCTCAGAATAGTGATGTGTTCGACGTTTTATCAAAGGC CCCCTTTCTATGTTCATGTTAGTTTTGCTCCTTCTGTGT TTTTTTCTGAACCATATCCATGTTGCTGACTTTTCCAAA TAAAGGTTTTCACTCCTCTC | 925 |
| 3UTR-013 | Calr; calreticulin | AGAGGCCTGCCTCCAGGGCTGGACTGAGGCCTGAGCG CTCCTGCCGCAGAGCTGGCCGCGCCAAATAATGTCTCT GTGAGACTCGAGAACTTTCATTTTTTTCCAGGCTGGTT CGGATTTGGGGTGGATTTTGGTTTTGTTCCCCTCCTCC ACTCTCCCCCACCCCCTCCCCGCCCTTTTTTTTTTTTT TTTTAAACTGGTATTTTATCTTTGATTCTCCTTCAGCCC TCACCCCTGGTTCTCATCTTTCTTGATCAACATCTTTTC TTGCCTCTGTCCCCTTCTCTCATCTCTTAGCTCCCCTCC AACCTGGGGGGCAGTGGTGTGGAGAAGCCACAGGCCT GAGATTTCATCTGCTCTCCTTCCTGGAGCCCAGAGGAG GGCAGCAGAAGGGGGTGGTGTCTCCAACCCCCCAGCA CTGAGGAAGAACGGGGCTCTTCTCATTTCACCCCTCCC TTTCTCCCCTGCCCCCAGGACTGGGCACTTCTGGGTG GGCAGTGGGTCCCAGATTGGCTCACACTGAGAATGT AAGAACTACAAACAAAATTTCTATTAAATTAAATTTTG TGTCTCC | 926 |

TABLE 20-continued

3'-Untranslated Regions

| 3' UTR Identifier | Name/ Description | Sequence | SEQ ID NO. |
|---|---|---|---|
| 3UTR-014 | Col1a1; collagen, type I, alpha 1 | CTCCCTCCATCCCAACCTGGCTCCCTCCCACCCAACCA ACTTTCCCCCCAACCCGGAAACAGACAAGCAACCCAA ACTGAACCCCTCAAAAGCCAAAAAATGGGAGACAAT TTCACATGGACTTTGGAAAATATTTTTTTCCTTTGCATT CATCTCTCAAACTTAGTTTTTATCTTTGACCAACCGAA CATGACCAAAAACCAAAAGTGCATTCAACCTTACCAA AAAAAAAAAAAAAAAAGAATAAATAAATAACTTTTT AAAAAAGGAAGCTTGGTCCACTTGCTTGAAGACCCAT GCGGGGGTAAGTCCCTTTCTGCCCGTTGGGCTTATGAA ACCCCAATGCTGCCCTTTCTGCTCCTTTCTCCACACCC CCCTTGGGGCCTCCCCTCCACTCCTTCCCAAATCTGTC TCCCCAGAAGACACAGGAAACAATGTATTGTCTGCCC AGCAATCAAAGGCAATGCTCAAACACCCAAGTGGCCC CCACCCTCAGCCCGCTCCTGCCCGCCCAGCACCCCCAG GCCCTGGGGACCTGGGGTTCTCAGACTGCCAAAGAA GCCTTGCCATCTGGCGCTCCCATGGCTCTTGCAACATC TCCCCTTCGTTTTTGAGGGGGTCATGCCGGGGGAGCCA CCAGCCCCTCACTGGGTTCGGAGGAGAGTCAGGAAGG GCCACGACAAAGCAGAAACATCGGATTTGGGGAACGC GTGTCAATCCCTTGTGCCGCAGGGCTGGGCGGGAGAG ACTGTTCTGTTCCTTGTGTAACTGTGTTGCTGAAAGAC TACCTCGTTCTTGTCTTGATGTGTCACCGGGGCAACTG CCTGGGGGCGGGGATGGGGCAGGGTGGAAGCGGCT CCCCATTTTATACCAAAGGTGCTACATCTATGTGATGG GTGGGGTGGGGAGGGAATCACTGGTGCTATAGAAATT GAGATGCCCCCCCAGGCCAGCAAATGTTCCTTTTTGTT CAAAGTCTATTTTTATTCCTTGATATTTTCTTTTTTTTT TTTTTTTTTGTGGATGGGGACTTGTGAATTTTTCTAAA GGTGCTATTTAACATGGGAGGAGAGCGTGTGCGGCTC CAGCCCAGCCCGCTGCTCACTTTCCACCCTCTCTCCAC CTGCCTCTGGCTTCTCAGGCCTCTGCTCTCCGACCTCT CTCCTCTGAAACCCTCCTCCACAGCTGCAGCCCATCCT CCCGGCTCCCTCCTAGTCTGTCCTGCGTCCTCTGTCCC CGGGTTTCAGAGACAACTTCCCAAAGCACAAAGCAGT TTTTCCCCCTAGGGGTGGGAGGAAGCAAAAGACTCTG TACCTATTTTGTATGTGTATAATAATTTGAGATGTTTTT AATTATTTTGATTGCTGGAATAAAGCATGTGGAAATG ACCCAAACATAATCCGCAGTGGCCTCCTAATTTCCTTC TTTGGAGTTGGGGAGGGGTAGACATGGGGAAGGGG CTTTGGGGTGATGGGCTTGCCTTCCATTCCTGCCCTTT CCCTCCCCACTATTCTCTTCTAGATCCCTCCATAACCC CACTCCCCTTTCTCTCACCCTTCTTATACCGCAAACCTT TCTACTTCCTCTTTCATTTTCTATTCTTGCAATTTCCTT GCACCTTTTCCAAATCCTCTTCTCCCCTGCAATACCAT ACAGGCAATCCACGTGCACAACACACACACACACTCT TCACATCTGGGGTTGTCCAAACCTCATACCCACTCCCC TTCAAGCCCATCCACTCTCCACCCCCTGGATGCCCTGC ACTTGGTGGCGGTGGGATGCTCATGGATACTGGGAGG GTGAGGGGAGTGGAACCCGTGAGGAGGACCTGGGGG CCTCTCCTTGAACTGACATGAAGGGTCATCTGGCCTCT GCTCCCTTCTCACCCACGCTGACCTCCTGCCGAAGGAG CAACGCAACAGGAGAGGGGTCTGCTGAGCCTGGCGAG GGTCTGGGAGGGACCAGGAGGAAGGCGTGCTCCCTGC TCGCTGTCCTGGCCCTGGGGGAGTGAGGGAGACAGAC ACCTGGGAGAGCTGTGGGGAAGGCACTCGCACCGTGC TCTTGGGAAGGAAGGAGACCTGGCCCTGCTCACCACG GACTGGGTGCCTCGACCTCCTGAATCCCCAGAACACA ACCCCCCTGGGCTGGGTGGTCTGGGGAACCATCGTG CCCCCGCCTCCCGCCTACTCCTTTTTAAGCTT | 927 |
| 3UTR-015 | Plod1; pro-collagen-lysine, 2-oxoglutarate 5-dioxygenase 1 | TTGGCCAGGCCTGACCCTCTTGGACCTTTCTTCTTTGC CGACAACCACTGCCCAGCAGCCTCTGGGACCTCGGGG TCCCAGGGAACCCAGTCCAGCCTCCTGGCTGTTGACTT CCCATTGCTCTTGGAGCCACCAATCAAAGAGATTCAA AGAGATTCCTGCAGGCCAGAGGCGGAACACACCTTTA TGGCTGGGGCTCTCCGTGGTGTTCTGGACCCAGCCCT GGAGACACCATTCACTTTTACTGCTTTGTAGTGACTCG TGCTCTCCAACCTGTCTTCCTGAAAAACCAAGGCCCCC TTCCCCCACCTCTTCCATGGGGTGAGACTTGAGCAGAA CAGGGGCTTCCCCAAGTTGCCCAGAAAGACTGTCTGG GTGAGAAGCCATGGCCAGAGCTTCTCCCAGGCACAGG TGTTGCACCAGGGACTTCTGCTTCAAGTTTTGGGGTAA AGACACCTGGATCAGACTCCAAGGGCTGCCCTGAGTC TGGGACTTCTGCCTCCATGGCTGGTCATGAGAGCAAA CCGTAGTCCCCTGGAGACAGCGACTCCAGAGAACCTC | 928 |

TABLE 20-continued

3'-Untranslated Regions

| 3' UTR Identifier | Name/ Description | Sequence | SEQ ID NO. |
|---|---|---|---|
| | | TTGGGAGACAGAAGAGGCATCTGTGCACAGCTCGATC TTCTACTTGCCTGTGGGAGGGGAGTGACAGGTCCAC ACACCACACTGGGTCACCCTGTCCTGGATGCCTCTGAA GAGAGGGACAGACCGTCAGAAACTGGAGAGTTTCTAT TAAAGGTCATTTAAACCA | |
| 3UTR-016 | Nucb1; nucleo-bindin 1 | TCCTCCGGGACCCCAGCCCTCAGGATTCCTGATGCTCC AAGGCGACTGATGGGCGCTGGATGAAGTGGCACAGTC AGCTTCCCTGGGGGCTGGTGTCATGTTGGGCTCCTGGG GCGGGGGCACGGCCTGGCATTTCACGCATTGCTGCCA CCCCAGGTCCACCTGTCTCCACTTTCACAGCCTCCAAG TCTGTGGCTCTTCCCTTCTGTCCTCCGAGGGGCTTGCC TTCTCTCGTGTCCAGTGAGGTGCTCAGTGATCGGCTTA ACTTAGAGAAGCCCGCCCCCTCCCCTTCTCCGTCTGTC CCAAGAGGGTCTGCTCTGAGCCTGCGTTCCTAGGTGG CTCGGCCTCAGCTGCCTGGGTTGTGGCCGCCCTAGCAT CCTGTATGCCCACAGCTACTGGAATCCCCGCTGCTGCT CCGGGCCAAGCTTCTGGTTGATTAATGAGGGCATGGG GTGGTCCCTCAAGACCTTCCCCTACCTTTTGTGGAACC AGTGATGCCTCAAAGACAGTGTCCCCTCCACAGCTGG GTGCCAGGGGCAGGGGATCCTCAGTATAGCCGGTGAA CCCTGATACCAGGAGCCTGGGCCTCCCTGAACCCCTG GCTTCCAGCCATCTCATCGCCAGCCTCCTCCTGGACCT CTTGGCCCCCAGCCCCTTCCCCACACAGCCCCAGAAG GGTCCCAGAGCTGACCCCACTCCAGGACCTAGGCCCA GCCCCTCAGCCTCATCTGGAGCCCCTGAAGACCAGTC CCACCCACCTTTCTGGCCTCATCTGACACTGCTCCGCA TCCTGCTGTGTGTCCTGTTCCATGTTCCGGTTCCATCCA AATACACTTTCTGGAACAAA | 929 |
| 3UTR-017 | α-globin | GCTGGAGCCTCGGTGGCCATGCTTCTTGCCCCTTGGGC CTCCCCCCAGCCCCTCCTCCCCTTCCTGCACCCGTACC CCCGTGGTCTTTGAATAAAGTCTGAGTGGCGGC | 930 |

5' UTR and Translation Initiation

Natural 5'UTRs bear features which play roles in translation initiation. They harbor signatures like Kozak sequences which are commonly known to be involved in the process by which the ribosome initiates translation of many genes. Kozak sequences have the consensus CCR(A/G) CCAUGG (SEQ ID NO: 965), where R is a purine (adenine or guanine) three bases upstream of the start codon (AUG), which is followed by another 'G'. 5'UTR also have been known to form secondary structures which are involved in elongation factor binding.

By engineering the features typically found in abundantly expressed genes of specific target organs, one can enhance the stability and protein production of the polynucleotides of the invention. For example, introduction of 5' UTR of liver-expressed mRNA, such as albumin, serum amyloid A, Apolipoprotein A/B/E, transferrin, alpha fetoprotein, erythropoietin, or Factor VIII, could be used to enhance expression of a nucleic acid molecule, such as a polynucleotides, in hepatic cell lines or liver. Likewise, use of 5' UTR from other tissue-specific mRNA to improve expression in that tissue is possible for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D).

Untranslated regions useful in the design and manufacture of polynucleotides (e.g., antigen-encoding polynucleotides featured in the NAVs of the invention) include, but are not limited, to those disclosed in co-pending, co-owned U.S. Provisional Application Ser. No. 61/829,372, U.S. Provisional Application 61/829,372 (USSN), and International Application, PCT/US14/21522 filed Mar. 7, 2014, the contents of each of which are incorporated herein by reference in its entirety.

Other non-UTR sequences may also be used as regions or subregions within the polynucleotides. For example, introns or portions of introns sequences may be incorporated into regions of the polynucleotides of the invention. Incorporation of intronic sequences may increase protein production as well as polynucleotide levels.

Combinations of features may be included in flanking regions and may be contained within other features. For example, the ORF may be flanked by a 5' UTR which may contain a strong Kozak translational initiation signal and/or a 3' UTR which may include an oligo(dT) sequence for templated addition of a poly-A tail. 5'UTR may comprise a first polynucleotide fragment and a second polynucleotide fragment from the same and/or different genes such as the 5'UTRs described in US Patent Application Publication No. 20100293625, herein incorporated by reference in its entirety.

US Provisional Application (USSN) 61/829,372 and U.S. Provisional Application 61/829,372 (USSN) provides a listing of exemplary UTRs which may be utilized in the polynucleotide of the present invention as flanking regions. Variants of 5' or 3' UTRs may be utilized wherein one or more nucleotides are added or removed to the termini, including A, T, C or G.

It should be understood that any UTR from any gene may be incorporated into the regions of the polynucleotide. Furthermore, multiple wild-type UTRs of any known gene may be utilized. It is also within the scope of the present invention to provide artificial UTRs which are not variants of wild type regions. These UTRs or portions thereof may be placed in the same orientation as in the transcript from which they were selected or may be altered in orientation or location. Hence a 5' or 3' UTR may be inverted, shortened, lengthened, made with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, polypeptides of interest may belong to a family of proteins which are expressed in a particular cell, tissue or at some time during development. The UTRs from any of these genes may be swapped for any other UTR of the same or different family of proteins to create a new polynucleotide. As used herein, a "family of proteins" is used in the broadest sense to refer to a group of two or more polypeptides of interest which share at least one function, structure, feature, localization, origin, or expression pattern.

The untranslated region may also include translation enhancer elements (TEE). As a non-limiting example, the TEE may include those described in US Application No. 20090226470, herein incorporated by reference in its entirety, and those known in the art.

3' UTR and the AU Rich Elements

Natural or wild type 3' UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA (U/A)(U/A) nonamers. Molecules containing this type of AREs include GM-CSF and TNF-α. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides of the invention (e.g., antigen-encoding polynucleotides featured in the NAVs of the invention). When engineering specific polynucleotides, one or more copies of an ARE can be introduced to make polynucleotides of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using polynucleotides of the invention and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection.

microRNA Binding Sites microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The polynucleotides of the invention (e.g., antigen-encoding polynucleotides featured in the NAVs of the invention) may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105; each of which is herein incorporated by reference in their entirety. The bases of the microRNA seed have complete complementarity with the target sequence. By engineering microRNA target sequences into the polynucleotides (e.g., in a 3'UTR like region or other region) of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/1eu.2011.356); Bartel Cell 2009 136:215-233; Landgraf et al, Cell, 2007 129:1401-1414; each of which is herein incorporated by reference in its entirety).

For example, if the nucleic acid molecule is an mRNA and is not intended to be delivered to the liver but ends up there, then miR-122, a microRNA abundant in liver, can inhibit the expression of the gene of interest if one or multiple target sites of miR-122 are engineered into the 3' UTR region of the polynucleotides. Introduction of one or multiple binding sites for different microRNA can be engineered to further decrease the longevity, stability, and protein translation of polynucleotides.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they occur, e.g., in order to increase protein expression in specific tissues. For example, miR-122 binding sites may be removed to improve protein expression in the liver. Regulation of expression in multiple tissues can be accomplished through introduction or removal or one or several microRNA binding sites.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126). MicroRNA can also regulate complex biological processes such as angiogenesis (miR-132) (Anand and Cheresh Curr Opin Hematol 2011 18:171-176; herein incorporated by reference in its entirety).

Expression profiles, microRNA and cell lines useful in the present invention include those taught in for example, U.S. Provisional Application Nos. 61/857,436 and 61/857,304 each filed Jul. 23, 2013, the contents of which are incorporated by reference in their entirety.

In the polynucleotides of the present invention, binding sites for microRNAs that are involved in such processes may be removed or introduced, in order to tailor the expression of the polynucleotides expression to biologically relevant cell types or to the context of relevant biological processes. A listing of microRNA, miR sequences and miR binding sites is listed in Table 9 of U.S. Provisional Application No. 61/753,661 filed Jan. 17, 2013, in Table 9 of U.S. Provisional Application No. 61/754,159 filed Jan. 18, 2013, and in Table 7 of U.S. Provisional Application No. 61/758,921 filed Jan. 31, 2013, each of which are herein incorporated by reference in their entireties.

Examples of use of microRNA to drive tissue or disease-specific gene expression are listed (Getner and Naldini, Tissue Antigens. 2012, 80:393-403; herein incoroporated by reference in its entirety). In addition, microRNA seed sites can be incorporated into mRNA to decrease expression in certain cells which results in a biological improvement. An example of this is incorporation of miR-142 sites into a UGT1A1-expressing lentiviral vector. The presence of miR-142 seed sites reduced expression in hematopoietic cells, and as a consequence reduced expression in antigen-presentating cells, leading to the absence of an immune response against the virally expressed UGT1A1 (Schmitt et al., Gastroenterology 2010; 139:999-1007; Gonzalez-Asequinolaza et al. Gastroenterology 2010, 139:726-729; both herein incorporated by reference in its entirety). Incorporation of miR-142 sites into modified mRNA could not only reduce expression of the encoded protein in hematopoietic cells, but could also reduce or abolish immune responses to the mRNA-encoded protein. Incorporation of miR-142 seed sites (one or multiple) into mRNA would be important in the case of treatment of patients with complete protein deficiencies (UGT1A1 type I, LDLR-deficient patients, CRIM-negative Pompe patients, etc.).

Lastly, through an understanding of the expression patterns of microRNA in different cell types, polynucleotides (e.g., antigen-encoding polynucleotides featured in the NAVs of the invention) can be engineered for more targeted expression in specific cell types or only under specific biological conditions. Through introduction of tissue-specific microRNA binding sites, polynucleotides could be designed that would be optimal for protein expression in a tissue or in the context of a biological condition.

Transfection experiments can be conducted in relevant cell lines, using engineered polynucleotides and protein production can be assayed at various time points post-transfection. For example, cells can be transfected with different microRNA binding site-engineering polynucleotides and by using an ELISA kit to the relevant protein and assaying protein produced at 6 hour, 12 hour, 24 hour, 48 hour, 72 hour and 7 days post-transfection. In vivo experiments can also be conducted using microRNA-binding site-engineered molecules to examine changes in tissue-specific expression of formulated polynucleotides.

Regions Having a 5' Cap

The 5' cap structure of a natural mRNA is involved in nuclear export, increasing mRNA stability and binds the mRNA Cap Binding Protein (CBP), which is responsibile for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5$^1$-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

In some embodiments, polynucleotides (e.g., antigen-encoding polynucleotides featured in the NAVs of the invention) may be designed to incorporate a cap moiety. Modifications to the polynucleotides of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thio-guanosine nucleotides according to the manufacturer's instructions to create a phosphorothioate linkage in the 5'-ppp-5' cap. Additional modified guanosine nucleotides may be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide which functions as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/or linked to the polynucleotides of the invention.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine (m$^7$G-3'mppp-G; which may equivalently be designated 3' 0-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, m$^7$Gm-ppp-G).

In one embodiment, the cap is a dinucleotide cap analog. As a non-limiting example, the dinucleotide cap analog may be modified at different phosphate positions with a boranophosphate group or a phophoroselenoate group such as the dinucleotide cap analogs described in U.S. Pat. No. 8,519, 110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present invention is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, may lead to reduced translational competency and reduced cellular stability.

Polynucleotides of the invention may also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present invention are those which, among other things, have enhanced binding of cap binding proteins, increased half life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N,pN2p (cap 0), 7mG(5')ppp(5')NlmpNp (cap 1), and 7mG(5')-ppp(5')NlmpN2mp (cap 2).

As a non-limiting example, capping chimeric polynucleotides post-manufacture may be more efficient as nearly 100% of the chimeric polynucleotides may be capped. This is in contrast to ~80% when a cap analog is linked to a chimeric polynucleotide in the course of an in vitro transcription reaction.

According to the present invention, 5' terminal caps may include endogenous caps or cap analogs. According to the present invention, a 5' terminal cap may comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Viral Sequences

Additional viral sequences such as, but not limited to, the translation enhancer sequence of the barley yellow dwarf virus (BYDV-PAV), the Jaagsiekte sheep retrovirus (JSRV) and/or the Enzootic nasal tumor virus (See e.g., International Pub. No. WO2012129648; herein incorporated by reference in its entirety) can be engineered and inserted in the polynucleotides of the invention and can stimulate the translation of the construct in vitro and in vivo. Transfection experiments can be conducted in relevant cell lines at and protein production can be assayed by ELISA at 12 hr, 24 hr, 48 hr, 72 hr and day 7 post-transfection.

IRES Sequences

Further, provided are polynucleotides (e.g., antigen-encoding polynucleotides featured in the NAVs of the invention) which may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. Polynucleotides containing more than one functional ribosome binding site may encode several peptides or polypeptides that are translated independently by the ribosomes ("multicistronic nucleic acid molecules"). When polynucleotides are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Poly-A Tails

During RNA processing, a long chain of adenine nucleotides (poly-A tail) may be added to a polynucleotide such as an mRNA molecule in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails may also be added after the construct is exported from the nucleus.

According to the present invention, terminal groups on the poly A tail may be incorporated for stabilization into polynucleotides of the invention (e.g., antigen-encoding polynucleotides featured in the RNAVs of the invention). Polynucleotides of the present invention may include des-3' hydroxyl tails. They may also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present invention (e.g., antigen-encoding polynucleotides featured in the NAVs of the invention) may be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present invention (e.g., antigen-encoding polynucleotides featured in the NAVs of the invention).

Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail is designed relative to the length of the overall polynucleotide or the length of a particular region of the polynucleotide. This design may be based on the length of a coding region, the length of a particular feature or region or based on the length of the ultimate product expressed from the polynucleotides.

In this context the poly-A tail may be 10, 20, 30, 40, 50, 60, 70, 80, 90, or 100% greater in length than the polynucleotide or feature thereof. The poly-A tail may also be designed as a fraction of the polynucleotides to which it belongs. In this context, the poly-A tail may be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein may enhance expression.

Additionally, multiple distinct polynucleotides may be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In one embodiment, the polynucleotides of the present invention (e.g., antigen-encoding polynucleotides featured in the NAVs of the invention) are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

Start Codon Region

In some embodiments, the polynucleotides of the present invention (e.g., antigen-encoding polynucleotides featured in the NAVs of the invention) may have regions that are analogous to or function like a start codon region.

In one embodiment, the translation of a polynucleotide may initiate on a codon which is not the start codon AUG. Translation of the polynucleotide may initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety). As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See e.g., Matsuda and Mauro PLoS ONE, 2010 5:11; the contents of which are herein incorporated by reference in its entirety). Masking any of the nucleotides flanking a codon that initiates translation may be used to alter the position of translation initiation, translation efficiency, length and/or structure of a polynucleotide.

In one embodiment, a masking agent may be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See e.g., Matsuda and Mauro describing masking agents LNA polynucleotides and EJCs (PLoS ONE, 2010 5:11); the contents of which are herein incorporated by reference in its entirety).

In another embodiment, a masking agent may be used to mask a start codon of a polynucleotide in order to increase the likelihood that translation will initiate on an alternative start codon.

In one embodiment, a masking agent may be used to mask a first start codon or alternative start codon in order to increase the chance that translation will initiate on a start codon or alternative start codon downstream to the masked start codon or alternative start codon.

In one embodiment, a start codon or alternative start codon may be located within a perfect complement for a miR binding site. The perfect complement of a miR binding site may help control the translation, length and/or structure of the polynucleotide similar to a masking agent. As a non-limiting example, the start codon or alternative start codon may be located in the middle of a perfect complement for a miR-122 binding site. The start codon or alternative start codon may be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide may be removed from the polynucleotide sequence in order to have the translation of the polynucleotide begin on a codon which is not the start codon. Translation of the polynucleotide may begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed may further comprise at least one masking agent for the downstream start codon and/or alternative start codons in order to control or attempt to control the initiation of translation, the length of the polynucleotide and/or the structure of the polynucleotide.

Stop Codon Region

In one embodiment, the polynucleotides of the present invention (e.g., antigen-encoding polynucleotides featured in the NAVs of the invention) may include at least two stop codons before the 3' untranslated region (UTR). The stop codon may be selected from TGA, TAA and TAG. In one embodiment, the polynucleotides of the present invention include the stop codon TGA and one additional stop codon. In a further embodiment the addition stop codon may be TAA. In another embodiment, the polynucleotides of the present invention include three stop codons.

Signal Sequences

The polynucleotides of the invention (e.g., antigen-encoding polynucleotides featured in the NAVs of the invention) may also encode additional features which facilitate trafficking of the polypeptides to therapeutically relevant sites. One such feature which aids in protein trafficking is the signal sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded polypeptide to the endoplasmic reticulum through one or more secretory pathways. Some signal peptides are cleaved from the protein by signal peptidase after the proteins are transported.

Additional signal sequences which may be utilized in the present invention include those taught in, for example, databases such as those found at http://www.signalpeptide.de/or http://proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

Protein Cleavage Signals and Sites

In exemplary embodiments, polypeptides of the invention (e.g., antigen polypeptides) may include various protein cleavage signals and/or sites.

In one embodiment, the polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

In one embodiment, the polynucleotides of the present invention may be engineered such that the polynucleotide contains at least one encoded protein cleavage signal. The encoded protein cleavage signal may be located in any region including but not limited to before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the polynucleotides of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

Insertions and Substitutions

In exemplary embodiments, polynucleotides of the invention (e.g., antigen-encoding polynucleotides featured in the NAVs of the invention) can include various substitutions and/or insertions.

In one embodiment, the 5'UTR of the polynucleotide may be replaced by the insertion of at least one region and/or string of nucleosides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the polynucleotide may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the polynucleotide may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside may cause a silent mutation of the sequence or may cause a mutation in the amino acid sequence.

In one embodiment, the polynucleotide may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the polynucleotide may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the polynucleotide may include at least one substitution and/or insertion upstream of the start codon. For the purpose of clarity, one of skill in the art would appreciate that the start codon is the first codon of the protein coding region whereas the transcription start site is the site where transcription begins. The polynucleotide may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the polynucleotide may be substituted with adenine, cytosine, thymine, or any of the nucleotides described herein. In another non-limiting example the substitution of guanine bases in the polynucleotide may be designed so as to leave one guanine base in the region downstream of the transcription start site and before the start codon (see Esvelt et al. Nature (2011) 472(7344): 499-503; the contents of which is herein incorporated by reference in its entirety). As a non-limiting example, at least 5 nucleotides may be inserted at 1 location downstream of the transcription start site but upstream of the start codon and the at least 5 nucleotides may be the same base type.

Incorporating Post Transcriptional Control Modulators

In one embodiment, the polynucleotides of the present invention (e.g., antigen-encoding polynucleotides featured in the NAVs of the invention) may include at least one post transcriptional control modulator. These post transcriptional control modulators may be, but are not limited to, small molecules, compounds and regulatory sequences. As a non-limiting example, post transcriptional control may be achieved using small molecules identified by PTC Therapeutics Inc. (South Plainfield, N.J.) using their GEMS™ (Gene Expression Modulation by Small-Molecules) screening technology.

The post transcriptional control modulator may be a gene expression modulator which is screened by the method detailed in or a gene expression modulator described in International Publication No. WO2006022712, herein incorporated by reference in its entirety. Methods identifying RNA regulatory sequences involved in translational control are described in International Publication No. WO2004067728, herein incorporated by reference in its entirety; methods identifying compounds that modulate untranslated region dependent expression of a gene are described in International Publication No. WO2004065561, herein incorporated by reference in its entirety.

In one embodiment, the polynucleotides of the present invention may include at least one post transcriptional control modulator is located in the 5' and/or the 3' untranslated region of the polynucleotides of the present invention.

In another embodiment, the polynucleotides of the present invention may include at least one post transcription control modulator to modulate premature translation termination. The post transcription control modulators may be compounds described in or a compound found by methods outlined in International Publication Nos. WO2004010106, WO2006044456, WO2006044682, WO2006044503 and WO2006044505, each of which is herein incorporated by reference in its entirety. As a non-limiting example, the compound may bind to a region of the 28S ribosomal RNA in order to modulate premature translation termination (See e.g., WO2004010106, herein incorporated by reference in its entirety).

In one embodiment, polynucleotides of the present invention may include at least one post transcription control modulator to alter protein expression. As a non-limiting example, the expression of VEGF may be regulated using the compounds described in or a compound found by the methods described in International Publication Nos. WO2005118857, WO2006065480, WO2006065479 and WO2006058088, each of which is herein incorporated by reference in its entirety.

The polynucleotides of the present invention may include at least one post transcription control modulator to control translation. In one embodiment, the post transcription control modulator may be a RNA regulatory sequence. As a non-limiting example, the RNA regulatory sequence may be identified by the methods described in International Publication No. WO2006071903, herein incorporated by reference in its entirety.

Codon Optimization

The polynucleotides contained in the NAVs of the invention, their regions or parts or subregions may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the polynucleotide. Codon optimization tools, algorithms and services are known in the art, non-limiting examples include services from GeneArt (Life Technologies), DNA2.0 (Menlo Park Calif.) and/or proprietary methods. In one embodiment, the ORF sequence is optimized using optimization algorithms. Codon options for each amino acid are given in Table 21.

TABLE 21

| Codon Options | | |
|---|---|---|
| Amino Acid | Single Letter Code | Codon Options |
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocystein insertion element (SECIS) |
| Stop codons | Stop | TAA, TAG, TGA |

Features, which may be considered beneficial in some embodiments of the present invention, may be encoded by regions of the polynucleotide and such regions may be upstream (5') or downstream (3') to a region which encodes a polypeptide. These regions may be incorporated into the polynucleotide before and/or after codon optimization of the protein encoding region or open reading frame (ORF). It is not required that a polynucleotide contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR region may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization.

After optimization (if desired), the polynucleotides components are reconstituted and transformed into a vector such as, but not limited to, plasmids, viruses, cosmids, and artificial chromosomes. For example, the optimized polynculeotide may be reconstituted and transformed into chemically competent E. coli, yeast, neurospora, maize, drosophila, etc. where high copy plasmid-like or chromosome structures occur by methods described herein.

Synthetic polynucleotides and their nucleic acid analogs play an important role in the research and studies of biochemical processes. Various enzyme-assisted and chemical-based methods have been developed to synthesize polynucleotides and nucleic acids, in particular, polynucleotides and nucleic acids featured in the NAVs of the invention, as described infra.

Synthesis: Enzymatic Methods

In Vitro Transcription-Enzymatic Synthesis cDNA encoding the polynucleotides described herein may be transcribed using an in vitro transcription (IVT) system. The system typically comprises a transcription buffer, nucleotide triphosphates (NTPs), an RNase inhibitor and a polymerase. The NTPs may be manufactured in house, may be selected from a supplier, or may be synthesized as described herein. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to incorporate polynucleotides (e.g., modified nucleic acids).

RNA Polymerases Useful for Synthesis

Any number of RNA polymerases or variants may be used in the synthesis of the polynucleotides of the present invention.

RNA polymerases may be modified by inserting or deleting amino acids of the RNA polymerase sequence. As a non-limiting example, the RNA polymerase may be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants may be obtained by evolving an RNA polymerase, optimizing the RNA polymerase amino acid and/or nucleic acid sequence and/or by using other methods known in the art. As a non-limiting example, T7 RNA polymerase variants may be evolved using the continuous directed evolution system set out by Esvelt et al. (Nature (2011) 472(7344):499-503; herein incorporated by reference in its entirety) where clones of T7 RNA polymerase may encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants may encode at least mutation as described in U.S. Pub. Nos. 20100120024 and 20070117112; herein incorporated by reference in their entireties. Variants of RNA polymerase may also include, but are not limited to, substitutional variants, conservative amino acid substitution, insertional variants, deletional variants and/or covalent derivatives.

In one embodiment, the polynucleotide may be designed to be recognized by the wild type or variant RNA polymerases. In doing so, the polynucleotide may be modified to contain sites or regions of sequence changes from the wild type or parent polynucleotide.

Polynucleotide or nucleic acid synthesis reactions may be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of E. Coli, Bacillus DNA polymerase I, Thermus aquaticus (Taq) DNA polymerases, and the T7 RNA and DNA polymerases, is among the best studied of these families. Another large family is DNA polymerase α (pol α) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA (Cheng et al., PNAS, Vol. 91, 5695-5699 (1994), the contents of which are incorporated herein by reference in their entirety). RNA polymerases from bacteriophage T3, T7, and SP6 have been widely used to prepare RNAs for biochemical and biophysical studies. RNA polymerases, capping enzymes, and poly-A polymerases are disclosed in the copending application No. PCT/US2013/054635 (M032), the contents of which are incorporated herein by reference in their entirety.

In one embodiment, the RNA polymerase which may be used in the synthesis of the chimeric polynucleotides described herein is a Syn5 RNA polymerase (see Zhu et al. Nucleic Acids Research 2013, the contents of which is herein incorporated by reference in its entirety). The Syn5 RNA polymerase was recently characterized from marine cyanophage Syn5 by Zhu et al. where they also identified the promoter sequence (see Zhu et al. Nucleic Acids Research 2013, the contents of which is herein incorporated by reference in its entirety). Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one embodiment, a Syn5 RNA polymerase may be used in the synthesis of the chimeric polynucleotides described herein. As a non-limiting example, a Syn5 RNA polymerase may be used in the synthesis of the chimeric polynucleotide requiring a precise 3'-termini.

In one embodiment, a Syn5 promoter may be used in the synthesis of the chimeric polynucleotides. As a non-limiting example, the Syn5 promoter may be 5'-ATTGGGCACCCG-TAAGGG-3' (SEQ ID NO: 966) as described by Zhu et al. (Nucleic Acids Research 2013, the contents of which is herein incorporated by reference in its entirety).

In one embodiment, a Syn5 RNA polymerase may be used in the synthesis of chimeric polynucleotides comprising at least one chemical modification described herein and/or known in the art. (see e.g., the incorporation of pseudo-UTP and 5Me-CTP described in Zhu et al. Nucleic Acids Research 2013, the contents of which is herein incorporated by reference in its entirety).

In one embodiment, the chimeric polynucleotides described herein may be synthesized using a Syn5 RNA polymerase which has been purified using modified and improved purification procedure described by Zhu et al. (Nucleic Acids Research 2013, the contents of which is herein incorporated by reference in its entirety).

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods may be applied in the manufacture of the polynucleotides of the invention.

Polymerase chain reaction (PCR) has wide applications in rapid amplification of a target gene, as well as genome mapping and sequencing. The key components for synthesizing DNA molecules as a template, primers complementary to the ends of target DNA strands, deoxynucleoside triphosphates (dNTPs) as building blocks, and a DNA polymerase. As PCR progresses through denaturation, annealing and extension steps, the newly produced DNA molecules can act as a template for the next circle of replication, achieving exponentially amplification of the target DNA. PCR requires a cycle of heating and cooling for denaturation and annealing. Variations of the basic PCR include, but are not limited to, asymmetric PCR (See e.g., Innis et al., *PNAS*, vol. 85, 9436-9440 (1988), the contents of which are incorporated herein by reference in their entirety), inverse PCR (see e.g., Ochman et al., *Genetics*, vol. 120(3), 621-623, (1988), the contents of which are incorporated herein by reference in their entirety), and reverse transcription PCR (RT-PCR) (see e.g., Freeman et al., *BioTechniques*, vol. 26(1), 112-22, 124-5 (1999), the contents of which are incorporated herein by reference in their entirety). In RT-PCR, a single stranded RNA is the desired target and is converted to a double stranded DNA first by reverse transcriptase.

A variety of isothermal in vitro nucleic acid amplification techniques have been developed as alternatives or complements of PCR. For example, strand displacement amplification (SDA) is based on the ability of a restriction enzyme to form a nick (Walker et al., *PNAS*, vol. 89, 392-396 (1992), the contents of which are incorporated herein by reference in their entirety). A restriction enzyme recognition sequence is inserted into an annealed primer sequence. Primers are extended by a DNA polymerase and dNTPs to form a duplex. Only one strand of the duplex is cleaved by the restriction enzyme. Each single strand chain is then available as a template for subsequent synthesis. SDA does not require the complicated temperature control cycle of PCR.

Nucleic acid sequence-based amplification (NASBA), also called transcription mediated amplification (TMA), is also an isothermal amplification method that utilizes a combination of DNA polymerase, reverse transcriptase, RNAse H, and T7 RNA polymerase (Compton, *Nature*, vol. 350, 91-92 (1991), the contents of which are incorporated herein by reference in their entirety). A target RNA is used as a template and a reverse transcriptase synthesizes its complementary DNA strand. RNAse H hydrolyzes the RNA template, making space for a DNA polymerase to synthesize a DNA strand complementary to the first DNA strand which is complementary to the RNA target, forming a DNA duplex. T7 RNA polymerase continuously generates complementary RNA strands of this DNA duplex. These RNA strands act as templates for new cycles of DNA synthesis, resulting in amplification of the target gene.

Rolling-circle amplification (RCA) amplifies a single stranded circular polynucleotide and involves numerous rounds of isothermal enzymatic synthesis where φ29 DNA polymerase extends a primer by continuously progressing around the polynucleotide circle to replicate its sequence over and over again. Therefore, a linear copy of the circular template is achieved. A primer can then be annealed to this linear copy and its complementary chain can be synthesized (Lizardi et al., *Nature Genetics*, vol. 19, 225-232 (1998), the contents of which are incorporated herein by reference in their entirety). A single stranded circular DNA can also serve as a template for RNA synthesis in the presence of an RNA polymerase (Daubendiek et al., *JACS*, vol. 117, 7818-7819 (1995), the contents of which are incorporated herein by reference in their entirety). An inverse rapid amplification of cDNA ends (RACE) RCA is described by Polidoros et al. (*BioTechniques*, vol. 41, 35-42 (2006), the contents of which are incorporated herein by reference in their entirety). A messenger RNA (mRNA) is reverse transcribed into cDNA, followed by RNAse H treatment to separate the cDNA. The cDNA is then circularized by CircLigase into a circular DNA. The amplification of the resulting circular DNA is archived with RCA.

Any of the foregoing methods may be utilized in the manufacture of one or more regions of the polynucleotides of the present invention (e.g., antigen-encoding polynucleotides featured in the NAVs of the invention).

Assembling polynucleotides or nucleic acids (e.g., antigen-encoding polynucleotides or nucleic acids) by a ligase is also widely used. DNA or RNA ligases promote intermolecular ligation of the 5' and 3' ends of polynucleotide chains through the formation of a phosphodiester bond. Ligase chain reaction (LCR) is a promising diagnosing technique based on the principle that two adjacent polynucleotide probes hybridize to one strand of a target gene and couple to each other by a ligase. If a target gene is not present, or if there is a mismatch at the target gene, such as a single-nucleotide polymorphism (SNP), the probes cannot ligase (Wiedmann et al., *PCR Methods and Application*, vol. 3 (4), s51-s64 (1994), the contents of which are incorporated herein by reference in their entirety). LCR may be combined with various amplification techniques to increase sensitivity of detection or to increase the amount of products if it is used in synthesizing polynucleotides and nucleic acids.

Several library preparation kits for nucleic acids are now commercially available. They include enzymes and buffers to convert a small amount of nucleic acid samples into an indexed library for downstream applications. For example, DNA fragments may be placed in a NEBNEXT® ULTRA™ DNA Library Prep Kit by NEWENGLAND BIOLABS® for end preparation, ligation, size selection, clean-up, PCR amplification and final clean-up.

Continued development is going on to improvement the amplification techniques. For example, U.S. Pat. No. 8,367, 328 to Asada et al. the contents of which are incorporated herein by reference in their entirety, teaches utilizing a reaction enhancer to increase the efficiency of DNA synthesis reactions by DNA polymerases. The reaction enhancer comprises an acidic substance or cationic complexes of an acidic substance. U.S. Pat. No. 7,384,739 to Kitabayashi et al. the contents of which are incorporated herein by reference in their entirety, teaches a carboxylate ion-supplying substance that promotes enzymatic DNA synthesis, wherein the carboxylate ioin-supplying substance is selected from oxalic acid, malonic acid, esters of oxalic acid, esters of malonic acid, salts of malonic acid, and esters of maleic acid. U.S. Pat. No. 7,378,262 to Sobek et al. the contents of which are incorporated herein by reference in their entirety, discloses an enzyme composition to increase fidelity of DNA amplifications. The composition comprises one enzyme with 3' exonuclease activity but no polymerase activity and another enzyme that is a polymerase. Both of the enzymes are thermostable and are reversibly modified to be inactive at lower temperatures.

U.S. Pat. No. 7,550,264 to Getts et al. teaches multiple round of synthesis of sense RNA molecules are performed by attaching oligodeoxynucleotides tails onto the 3' end of cDNA molecules and initiating RNA transcription using RNA polymerase, the contents of which are incorporated herein by reference in their entirety. US Pat. Publication No. 2013/0183718 to Rohayem teaches RNA synthesis by RNA-dependent RNA polymerases (RdRp) displaying an RNA polymerase activity on single-stranded DNA templates, the contents of which are incorporated herein by reference in their entirety. Oligonucleotides with non-standard nucleotides may be synthesized with enzymatic polymerization by contacting a template comparing non-standard nucleotides with a mixture of nucleotides that are complementary to the nucleotides of the template as disclosed in U.S. Pat. No. 6,617,106 to Benner, the contents of which are incorporated herein by reference in their entirety.

Synthesis: Solid-Phase Chemical Synthesis

Chimeric polynucleotides or circular polynucleotides of the present invention (e.g., antigen-encoding polynucleotides featured in the NAVs of the invention) may be manufactured in whole or in part using solid phase techniques.

Solid-phase chemical synthesis of polynucleotides or nucleic acids is an automated method wherein molecules are immobilized on a solid support and synthesized step by step in a reactant solution. Impurities and excess reagents are washed away and no purification is required after each step. The automation of the process is amenable on a computer-controlled solid-phase synthesizer. Solid-phase synthesis allows rapid production of polynucleotides or nucleic acids in a relatively large scale that leads to the commercial availability of some polynucleotides or nucleic acids. Furthermore, it is useful in site-specific introduction of chemical modifications in the polynucleotide or nucleic acid sequences. It is an indispensable tool in designing modified derivatives of natural nucleic acids.

In automated solid-phase synthesis, the chain is synthesized in 3' to 5' direction. The hydroxyl group in the 3' end of a nucleoside is tethered to a solid support via a chemically cleavable or light-cleavable linker. Activated nucleoside monomers, such as 2'-deoxynucleosides (dA, dC, dG and T), ribonucleosides (A, C, G, and U), or chemically modified nucleosides, are added to the support-bound nucleoside sequentially. Currently most widely utilized monomers are the 3'-phophoramidite derivatives of nucleoside building blocks. The 3' phosphorus atom of the activated monomer couples with the 5' oxygen atom of the support-bound nucleoside to form a phosphite triester. To prevent side reactions, all functional groups not involved in the coupling reaction, such as the 5' hydroxyl group, the hydroxyl group on the 3' phosphorus atom, the 2' hydroxyl group in ribonucleosides monomers, and the amino groups on the purine or pyrimidine bases, are all blocked with protection groups. The next step involves oxidation of the phosphite triester to form a phosphate triester or phosphotriester, where the phosphorus atom is pentavalent. The protection group on the 5' hydroxyl group at the end of the growing chain is then removed, ready to couple with an incoming activated monomer building block. At the end of the synthesis, a cleaving agent such as ammonia or ammonium hydroxide is added to remove all the protecting groups and release the polynucleotide chains from the solid support. Light may also be applied to cleave the polynucleotide chain. The product can then be further purified with high pressure liquid chromatography (HPLC) or electrophoresis.

In solid-phase synthesis, the polynucleotide chain is covalently bound to the solid support via its 3' hydroxyl group. The solid supports are insoluble particles also called resins, typically 50-200 μm in diameter. Many different kinds of resins are now available, as reviewed in "Solid-phase supports for polynucleotide synthesis" by Guzaev (Guzaev, Current Protocols in Nucleic Acid Chemistry, 3.1.1-3.1.60 (2013), the contents of which are incorporated herein by reference in their entirety). The most common materials for the resins include highly cross-linked polystyrene beads and controlled pore glass (CPG) beads. The surface of the beads may be treated to have functional groups, such as amino or aminomethyl groups that can be used as anchoring points for linkers to tether nucleosides. They can be implemented in columns, multi-well plates, microarrays or microchips. The column-based format allows relatively large scale synthesis of the polynucleotides or nucleic acids. The resins are held between filters in columns that enable all reagents and solvents to pass through freely. Multi-well plates, microarrays, or microchips are designed specifically for cost-effective small scale synthesis. Up to a million polynucleotides can be produced on a single microarray chip. However, the error rates of microchip-based synthesis are higher than traditional column-based methods (Borovkov et al., Nucleic Acids Research, vol. 38(19), e180 (2010), the contents of which are incorporated herein by reference in their entirety). Multi-well plates allow parallel synthesis of polynucleotides or nucleic acids with different sequences simultaneously (Sindelar, et al., Nucleic Acids Research, vol. 23, 982-987 (1995), the contents of which are incorporated herein by reference in their entirety). The loading on the solid supports is limited. In addition, as the extension progresses, the morphology and bulkiness of the growing chains on the solid supports might hinder the incoming monomers from reacting with the terminal group of the growing chains. Therefore, the number of monomers that can be added to the growing chain is also limited.

Linkers are attached to the solid support for further extension of the chain. They are stable to all the reagents used in the synthesis process, except in the end of the synthesis when the chain is detached from the solid support. Solid supports with a specific nucleoside linker, i.e., A, C, dT, G, or U, can be used to prepare polynucleotides with A, C, T, G, or U as the first nucleotide in the sequence, respectively. Universal solid supports with non-nucleoside linkers can be used for all polynucleotide sequences (U.S. Pat. No. 6,653,468 to Guzaev et al., the contents of which are incorporated herein by reference in their entirety). Various non-nucleoside linkers have been developed for universal supports, a lot of them with two vicinal hydroxyl groups. For example, a succinyl group is a frequently used linker.

As used herein, a linker refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety. A linker may be nucleic acid based or non-nucleosidic. The linker may be of sufficient length as to not interfere with incorporation into a nucleic acid sequence. The linker can be used for any useful purpose, such as to form multimers (e.g., through linkage of two or more chimeric polynucleotides molecules) or conjugates, as well as to administer a therapeutic molecule or incorporate a label, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.)

Besides the functional groups on the activated monomer and the growing chain needed for the coupling reaction to extend the chain, all other functional groups need to be protected to avoid side reactions. The conditions for protection and deprotection, and the selection of appropriate protecting groups can be readily determined by one skilled in the art. The chemistry of protecting groups can be found and/or described, for example, in Greene, et al. (*Protective Groups in Organic Synthesis*, 2d. Ed., Wiley & Sons, 1991, the contents of which is incorporated herein by reference in its entirety.) For example, the 5' hydroxyl group on the activated nucleoside phosphoramidite monomers may be protected with 4,4'-dimethoxytrityl (DMT) and the hydroxyl group on the phosphorus atom may be protected with 2-cyanoethyl. The exocyclic amino groups on the A, C, G bases may be protected with acyl groups.

In a solid-phase synthesis system, the reactivity of the activated monomers is important, because of the heterogeneity of the media. A majority of solid-phase synthesis uses phosphoramidite nucleosides, the mechanism of which is discussed above. Another activated monomer example is nucleoside H-phosphonates (Abramova, *Molecules*, vol. 18, 1063-1075 (2013), the contents of which are incorporated herein by reference in their entirety). A large excess of reagents, such as monomers, oxidizing agents, and deprotection agents, is required in order to ensure high yields in the solid-phase synthesis system.

Scientific studies and research are going on to further improve the solid-phase synthesis method. For example, instead of the well-established 3'-to-5' synthesis, U.S. Pat. No. 8,309,707 and US Pat. Publication No. 2013/0072670 to Srivastava et al. disclosed a 5'-to-3' synthesis of RNA utilizing a novel phosphoramidite and a novel nucleoside derivative, thereby allowing easy modifications of the synthetic RNA at the 3' end. PCT application WO2013123125 to Church et al. the contents of which are incorporated herein by reference in their entirety, describes assembly of a target nucleic acid sequence from a plurality of subsequences, wherein resins with the subsequences are placed in an emulsion droplet. The subsequences are cleaved off the resins and assemble within the emulsion droplet. To reduce the cost of solid supports, a reusable CPG solid support has been developed with a hydroquinone-O,O'-diacetic acid linker (Q-linker) (Pon et al., *Nucleic Acid Research*, vol. 27, 1531-1538 (1999), the contents of which are incorporated herein by reference in their entirety).

New protecting groups for solid-phase synthesis have also been developed. Nagat et al. has successfully synthesized 110-nt-long RNA with the sequence of a candidate precursor microRNA by using 2-cyanoethoxymethyl (CEM) as the 2'-hydroxy protecting group (Shiba et al., *Nucleic Acids Research*, vol. 35, 3287-3296 (2007), the contents of which are incorporated herein by reference in their entirety). Also with CEM as 2'-O-protecting group, a 130-nt mRNA has been synthesized encoding a 33-amino acid peptide that includes the sequence of glucagon-like peptide-1 (GLP-1). The biological activity of the artificial 130-nt mRNA is shown by producing GLP-1 in a cell-free protein synthesis system and in Chinese hamster ovary (CHO) cells (Nagata et al., *Nucleic Acids Research*, vol. 38(21), 7845-7857 (2010), the contents of which are incorporated herein by reference in their entirety). Novel protecting groups for solid-phase synthesis monomers include, but are not limited to, carbonate protecting group disclosed in U.S. Pat. No. 8,309,706 to Dellinger et al., orthoester-type 2' hydroxyl protecting group and an acyl carbonate-type hydroxyl protecting group disclosed in U.S. Pat. No. 8,242,258 to Dellinger et al., 2'-hydroxyl thiocarbon protecting group disclosed in U.S. Pat. No. 8,202,983 to Dellinger et al., 2'-silyl containing thiocarbonate protecting group disclosed in U.S. Pat. No. 7,999,087 to Dellinger et al., 9-fluorenylmethoxycarbonyl (FMOS) derivatives as an amino protecting group disclosed in U.S. Pat. No. 7,667,033 to Alvarado, fluoride-labile 5'silyl protecting group disclosed in U.S. Pat. No. 5,889,136 to Scaringe et al., and pixyl protecting groups disclosed in US Pat. Publication No. 2008/0119645 to Griffey et al., the contents of which are incorporated herein by reference in their entirety. US Pat. Publication No. 2011/0275793 to Debart et al. teaches RNA synthesis using a protecting group of the hyoxyls in position 2' of the ribose that can be removed by a base, the contents of which are incorporated herein by reference in their entirety. Novel solid supports include polymers made from monomers comprising protected hydroxypoly$C_{2-4}$alkyleneoxy chain attached to a polymerizable unit taught in U.S. Pat. No. 7,476,709 to Moody et al., the contents of which are incorporated herein by reference in their entirety.

Synthesis: Liquid Phase Chemical Synthesis

The synthesis of chimeric polynucleotides or circular polynucleotides of the present invention (e.g., antigen-encoding polynucleotides featured in the NAVs of the invention) by the sequential addition of monomer building blocks may be carried out in a liquid phase. A covalent bond is formed between the monomers or between a terminal functional group of the growing chain and an incoming monomer. Functional groups not involved in the reaction must be temporarily protected. After the addition of each monomer building block, the reaction mixture has to be purified before adding the next monomer building block. The functional group at one terminal of the chain has to be deprotected to be able to react with the next monomer building blocks. A liquid phase synthesis is labor- and time-consuming and cannot not be automated. Despite the limitations, liquid phase synthesis is still useful in preparing short polynucleotides in a large scale. Because the system is homogenous, it does not require a large excess of reagents and is cost-effective in this respect.

Synthesis: Combination of Synthetic Methods

The synthetic methods discussed above each has its own advantages and limitations. Attempts have been conducted to combine these methods to overcome the limitations. Such combinations of methods are within the scope of the present invention.

Short polynucleotide chains with 2-4 nucleotides may be prepared in liquid phase followed by binding to a solid support for extension reactions by solid phase synthesis. A high efficiency liquid phase (HELP) synthesis is developed that uses monomethyl ether of polyethylene glycol (MPEG) beads as a support for the monomer building blocks. MPEG is soluble in methylene chloride and pyridine solvents but precipitates in a diethyl ether solvent. By choosing an appropriate solvent, the coupling reaction between monomers or between a growing chain and an incoming monomer bound on MPEG can be carried out in a homogenous liquid phase system. The mixture can then be washed with a diethyl ether solvent to easily precipitate and purify the product (Bonora et al., *Nucleic Acids Research*, vol. 18, 3155-3159 (1990), the contents of which are incorporated herein by reference in their entirety). U.S. Pat. No. 8,304,532 to Adamo et al., the contents of which are incorporated herein in their entirety, teaches a solution phase oligonucleotide synthesis where at least some of the reagents are solid supported.

The use of solid-phase or liquid-phase chemical synthesis in combination with enzymatic ligation provides an efficient way to generate long chain polynucleotides that cannot be obtained by chemical synthesis alone. Moore and Sharp describe preparing RNA fragments 10- to 20-nt long by chemical synthesis, to which site-specific modifications may be introduced, annealing the fragments to a cDNA bridge, and then assemble the fragments with T4 DNA ligase (Moore et al., *Science*, vol. 256, 992-997 (1992), the contents of which are incorporated herein by reference in their entirety).

A solid-phase synthesizer may produce enough polynucleotides or nucleic acids with good purity to preform PCR and other amplification techniques. Agilent Technologies have developed microarrays that are commercially available. Polynucleotides may be synthesized on a microarray substrate, cleaved by a strong base or light, followed by PCR amplification to generate a library of polynucleotides (Cleary et al., *Nature Methods*, vol. 1(3), 241-247 (2004), the contents of which are incorporated herein by reference in their entirety).

Synthesis: Small Region Synthesis

Regions or subregions of the polynucleotides of the present invention (e.g., antigen-encoding polynucleotides featured in the NAVs of the invention) may comprise small RNA molecules such as siRNA, and therefore may be synthesized in the same manner. There are several methods for preparing siRNA, such as chemical synthesis using appropriately protected ribonucleoside phosphoramidites, in vitro transcription, siRNA expression vectors, and PCR expression cassettes. Sigma-Aldrich® is one of the siRNA suppliers and synthesizes their siRNA using ribonucleoside phosphoramidite monomers protected at the 2' position with a t-butylmethylsilyl (TBDMS) group. The solid-phase chemical synthesis is carried out with SIGMA-ALDRICH®'s Ultra Fast Parallel Synthesis (UFPS) and Ultra Fast Parallel Deprotection (UFPD) to achieve high coupling efficiency and fast deprotection. The final siRNA products may be purified with HPLC or PAGE. Such methods may be used to synthesize regions or subregions of chimeric polynucleotides.

In vitro transcription and expression from a vector or a PCR-generated siRNA cassette require appropriate templates to produce siRNAs. The commercially available AMBION® SILENCER® siRNA construction kit produces siRNA by in vitro transcription of DNA templates and contains the enzymes, buffers, primers needed. Such methods may be used to synthesize regions or subregions of chimeric polynucleotides.

Synthesis: Ligation of Polynucleotide Regions or Subregions

Polynucleotides of the invention (e.g., antigen-encoding polynucleotides featured in the NAVs of the invention) such as chimeric polynucleotides and/or circular polynucleotides may be prepared by ligation of one or more regions or subregions.

Ligation is an indispensable tool for assembling polynucleotide or nucleic acid fragments into larger constructs. DNA fragments can be joined by a ligase catalyzed reaction to create recombinant DNA with different functions. Two oligodeoxynucleotides, one with a 5' phosphoryl group and another with a free 3' hydroxyl group, serve as substrates for a DNA ligase. Oligodexoynucleotides with fluorescent or chemiluminescent labels may also serve as DNA ligase substrates (Martinelli et al., *Clinical Chemistry*, vol. 42, 14-18 (1996), the contents of which are incorporated herein by reference in their entirety). RNA ligases such as T4 RNA ligase catalyze the formation of a phosphodiester bond between two single stranded oligoribonucleotides or RNA fragments. Copies of large DNA constructs have been synthesized with a combination of polynucleotide fragments, thermostable DNA polymerases, and DNA ligases. US Pat. Publication No. 2009/0170090 to Ignatov et al., the contents of which are incorporated herein by reference in their entirety, discloses improving PCT, especially enhancing yield of a long distance PCR and/or a low copy DNA template PCR amplication, by using a DNA ligase in addition to a DNA polymerase.

Ligases may be used with other enzymes to prepare desired chimeric polynucleotide or nucleic acid molecules and to perform genome analysis. For example, ligation-mediated selective PCR amplification is disclosed in EP Pat. Pub. No. 0735144 to Kato. Complementary DNAs (cDNAs) reverse-transcribed from tissue- or cell-derived RNA or DNA are digested into fragments with type IIS restriction enzymes the contents of which are incorporated herein by reference in their entirety. Biotinylated adapter sequences are attached to the fragments by *E. coli* DNA ligases. The biotin-labeled DNA fragments are then immobilized onto streptavidin-coated beads for downstream analysis.

A ligation splint or a ligation splint oligo is an oligonucleotide that is used to provide an annealing site or a ligation template for joining two ends of one nucleic acid, i.e., intramolecular joining, or two ends of two nucleic acids, i.e., intermolecular joining, using a ligase or another enzyme with ligase activity. The ligation splint holds the ends adjacent to each other and creates a ligation junction between the 5'-phosphorylated and a 3'-hydroxylated ends that are to be ligated.

In one embodiment, a splint-mediated ligation or splint ligation method may be used to synthesize the chimeric polynucleotides described herein. The chimeric polynucleotide may be assembled using a method that does not rely on the presence of restriction endonuclease cleavage sites such as the method described in International Patent Publication No. WO2012138453, the contents of which are herein incorporated by reference in its entirety. Splint-mediated ligation allows for the rapid synthesis of the construct using controlled concatenation and without the need or with limited need for the introduction of restriction sites at the joining regions. As a non-limiting example, splint ligation may be used to add at least one untranslated region to a coding region of the chimeric polynucleotide. In one embodiment, splint ligation may be used in combination with other synthesis methods in the synthesis of the chimeric polynucleotides described herein.

If the 5'-phosphorylated and the 3'-hydroxyl ends of nucleic acids are ligated when the ends are annealed to a ligation splint so that the ends are adjacent, enzymes such as, but not limited to, T4 DNA ligase, AMPLIGASE® DNA Ligase (EPICENTRE® Technologies), Tth DNA ligase, Tfl DNA ligase, or Tsc DNA Ligase (Prokaria) can be used. Farugui Ind. U.S. Pat. No. 6,368,801 (the contents of which is incorporated by reference in its entirety) describes that T4 RNA ligase can efficiently ligate ends of DNA molecules that are adjacent to each other when hybridized to an RNA splint. Thus, T4 RNA ligase is a suitable ligase for joining DNA ends with a ligation splint oligo comprising RNA or modified RNA. Examples of RNA splints include modified RNA containing 2'-fluorine-CTP (2'-F-dCTP) and 2'-fluorine-UTP (2'-F-dUTP) made using the DURASCRIBE® T7 Transcription Kit (EPICENTRE® Technologies) disclosed in U.S. Pat. No. 8,137,911 and US Pat. Publication 2012/0156679 to Dahl et al, the contents of each of which are incorporated herein by reference in their entirety. The modified RNA produced from DURASCRIBE® T7 Transcription kit is completely resistant to RNase A digestion. DNA splint and DNA ligase may be used to generate RNA-protein fusions disclosed in U.S. Pat. No. 6,258,558 to Szostak et al., the contents of which are incorporated herein by reference in their entirety.

For intramolecular ligation of linear ssDNA, U.S. Pat. No. 7,906,490 to Kool et al. teaches constructing a 83-nucleotide circle by making linear oligodeoxynucleotides fragments on a DNA synthesizer followed by ligation with T4 DNA ligase and two 30 nucleotide splint oligonucleotides. Circulation of linear sense promoter-containing cDNA is disclosed in US Pat. Publication No. 2012/0156679 to Dahl et al., the contents of which are incorporated herein by reference in their entirety. THERMOPHAGE™ ssDNA ligase (Prokazyme), which is derived from phage TS2126 that infects *Thermus scotoductus*, catalyzes ATP-dependent intra- and inter-molecular ligation of DNA and RNA.

The solid-phase chemical synthesis method that uses phosphoramidite monomers is limited to produce DNA molecules with short strands. The purity of the DNA products and the yield of reactions become poor when the length exceeds 150 bases. For the synthesis of long polynucleotides in high yields, it is more convenient to use enzymatic ligation method in tandem with chemical synthesis. For example, Moore and Sharp describe preparing RNA fragments 10- to 20-nt long by chemical synthesis, to which site-specific modifications may be introduced, annealing the fragments to a cDNA splint, and then assemble the fragments with T4 DNA ligase (Moore et al., *Science*, vol. 256, 992-997 (1992), the contents of which are incorporated herein by reference in their entirety). Ligation reactions of oligoribonucleotides with T4 RNA ligase and a DNA splint or a polyribonucleotide to generate large, synthetic RNAs are described in Bain et al., *Nucleic Acids Research*, vol. 20(16), 4372 (1992), Stark et al., *RNA*, vol. 12, 2014-2019 (2006), and US Pat. Application No. 2005/0130201 to Deras et al., the contents of each of which are incorporated herein by reference in their entirety. 5'-cap and 3'-polyA tail are often added by enzymatic addition to an oligonucleotide synthesized with solid-phase methods. As a non-limiting example, a synthetic capped 42-mer mRNA has been synthesized in three fragments enzymatically ligated as described by Iwase et al. (*Nucleic Acids Research*, vol. 20, 1643-1648 (1992), the contents of which are incorporated herein by reference in their entirety). As another example, a 16.3-kilobase mouse mitochondrial genome has been produced from 600 overlapping 60-mer polynucleotides. The method cycles between in vitro recombination and amplification may be repeated until the desired length is reached (Gibson et al., *Nature Methods*, vol. 7, 901-903 (2010), the contents of which are incorporated herein by reference in their entirety). The assembly of a 1.08 megabase *Mycoplasma mycoides* JCVI-syn1.0 genome has also been reported. As a non-limiting example, 1080 bp cassettes are produced by assembling polynucleotide fragments chemically generated from a polynucleotide synthesizer. The genome is then assembled in three stages by transformation and homologous recombination in yeast (Gibson, et al., *Science*, vol. 329, 52-56 (2010), the contents of which are incorporated herein by reference in their entirety).

Studies have been conducted to join short DNA fragments with chemical linkers. 'Click' chemistry or 'click' ligation, the cycloaddition reaction between azide and alkyne, has gained a lot of interest because of its advantages such as mild reaction condition, high yields, and inoffensive byproducts. 'Click' chemistry is reviewed by Nwe et al. in *Cancer Biotherapy and Radiopharmaceuticals*, vol. 24(3), 289-302 (2009), the contents of which are incorporated here by reference for their entirety. DNA constructs up to 300 bases in length have been produced with click ligation and longer sequences are feasible. Demonstrated with PCR data, various DNA polymerases are able to amplify the synthesized DNA constructs made by click ligation despite the triazole linkers between the fragments resulting from the cycloaddition reaction. In vitro transcription and rolling circle amplification can also be performed on the synthesized DNA constructs. Hairpin ribozymes up to 100 nucleotides in length and cyclic mini-DNA duplexes have also been prepared with click ligation (El-Sagheer et al., *Accounts of Chemical Research*, vol. 45(8), 1258-1267 (2012), the contents of which are incorporated herein by reference in their entirety).

Sequential ligation can be performed on a solid substrate. For example, initial linker DNA molecules modified with biotin at the end are attached to streptavidin-coated beads. The 3'-ends of the linker DNA molecules are complimentary with the 5'-ends of the incoming DNA fragments. The beads are washed and collected after each ligation step and the final linear constructs are released by a meganuclease. This method allows rapid and efficient assembly of genes in an optimized order and orientation. (Takita, *DNA Research*, vol. 20(4), 1-10 (2013), the contents of which are incorporated herein by reference in their entirety). Labeled polynucleotides synthesized on solid-supports are disclosed in US Pat. Pub. No. 2001/0014753 to Soloveichik et al. and US Pat. Pub. No. 2003/0191303 to Vinayak et al., the contents of which are incorporated herein by reference for their entirety.

Quantification

In one embodiment, the polynucleotides of the present invention (e.g., antigen-encoding polynucleotides featured in the NAVs of the invention) may be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present invention differ from the endogenous forms due to the structural or chemical modifications.

In one embodiment, the polynucleotide may be quantified using methods such as, but not limited to, ultraviolet visible spectroscopy (UV/Vis). A non-limiting example of a UV/Vis spectrometer is a NANODROP® spectrometer (Thermo-Fisher, Waltham, Mass.). The quantified polynucleotide may be analyzed in order to determine if the polynucleotide may be of proper size, check that no degradation of the polynucleotide has occurred. Degradation of the polynucleotide may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Purification

Purification of the polynucleotides of the invention (e.g., antigen-encoding polynucleotides featured in the NAVs of the invention) described herein may include, but is not limited to, polynucleotide clean-up, quality assurance and quality control. Clean-up may be performed by methods known in the arts such as, but not limited to, AGEN-COURT® beads (Beckman Coulter Genomics, Danvers, Mass.), poly-T beads, LNA™ oligo-T capture probes (EX-IQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified polynucleotide" refers to one that is separated from at least one contaminant. As used herein, a "contaminant" is any substance which makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the polynucleotides may be sequenced by methods including, but not limited to reverse-transcriptase-PCR.

IV. Modifications

In exemplary embodiments, polynucleotides of the invention (e.g., antigen-encoding polynucleotides featured in the NAVs of the invention) can include various substitutions and/or insertions.

The data presented in the Examples demonstrate significant enhanced immune responses using the formulations of the invention. The data demonstrated the effectiveness of both chemically modified and unmodified RNA vaccines of the invention. Surprisingly, in contrast to prior art reports that it was preferable to use chemically unmodified mRNA formulated in a carrier for the production of vaccines, it was discovered herein that chemically modified mRNA-LNP vaccines required a much lower effective mRNA dose than unmodified mRNA, i.e., tenfold less than unmodified mRNA.

Additionally, a study described herein involved intravenous (IV), intramuscular (IM), or intradermal (ID) vaccination of mice, followed by challenge with a lethal dose of virus. In addition to all of the vaccinated animals surviving the lethal dose, significantly stronger early immune responses were observed (anti-viral activity via virus neutralization assay and HA inhibition (HAI)) in comparison to protein antigen and other lipid based formulations (lipoplex). The data demonstrated that as early as 1 week after vaccination both groups of animals receiving a chemically modified mRNA-LNP formulation (ID or IM) displayed HAI titers over 40, at 60 and 114, respectively. An HAI titer of greater than 40 is deemed sufficient to protect from a lethal challenge of influenza. The rapid response was unexpected, particularly when compared to the response seen with protein antigen and mRNA vaccines formulated in other lipid carriers (lipoplex), which at one week and even at three weeks following vaccination continued to show ineffective HAI titers of less than 40.

At each of the later time points (3 weeks and 5 weeks), the formulations of the invention continued to provide significantly stronger therapeutic responses than did protein antigen. In fact even chemically unmodified mRNA-LNP formulation administered by IV route had enhanced HAI titers with respect to the protein antigen. By week 3, all of the animals receiving an mRNA-LNP formulation by IM or ID administration displayed HAI activity over 40, as compared to protein antigen, which at one week and three weeks continued to show HAI titers of less than 40. By week 5 the chemically modified mRNA-LNP formulation administered by ID route had a surprising HAI activity of greater than 10,000, in contrast to the HAI titer of around 400 for protein antigen at that time point.

Both the chemically modified and unmodified RNA vaccines of the invention produced better immune responses than did mRNA vaccines formulated in a different lipid carrier (lipoplex). At week 5 the non-chemically modified mRNA-lipoplex vaccine produced HAI titers of 197, in comparison to those achieved by the mRNA-LNP formulations of the invention (HAI titers of 635-10,152). At all other time points and for all of the chemically modified mRNA-lipoplex vaccines, none of the HAI titers reached the critical level of greater than 40. Additionally, the mRNA-lipoplex vaccine did not result in any detectable neutralizing activity in the microneutralization activity, even as late as five weeks after vaccination.

As used herein in a polynucleotide (such as a chimeric polynucleotide, IVT polynucleotide or a circular polynucleotide), the terms "chemical modification" or, as appropriate, "chemically modified" refer to modification with respect to adenosine (A), guanosine (G), uridine (U), thymidine (T) or cytidine (C) ribo- or deoxyribonucleosides in one or more of their position, pattern, percent or population. Generally, herein, these terms are not intended to refer to the ribonucleotide modifications in naturally occurring 5'-terminal mRNA cap moieties.

In a polypeptide, the term "modification" refers to a modification as compared to the canonical set of 20 amino acids.

The modifications may be various distinct modifications. In some embodiments, the regions may contain one, two, or more (optionally different) nucleoside or nucleotide modifications. In some embodiments, a modified polynucleotide, introduced to a cell may exhibit reduced degradation in the cell, as compared to an unmodified polynucleotide.

Modifications of the polynucleotides of the NAVs which are useful in the present invention include, but are not limited to those in Table 22. Noted in the table are the symbol of the modification, the nucleobase type and whether the modification is naturally occurring or not.

TABLE 22

| Modifications | | | |
|---|---|---|---|
| Name | Symbol | Base | Naturally Occurring |
| 2-methylthio-N6-(cis-hydroxyisopentenyl)adenosine | ms2i6A | A | YES |
| 2-methylthio-N6-methyladenosine | ms2m6A | A | YES |
| 2-methylthio-N6-threonyl carbamoyladenosine | ms2t6A | A | YES |
| N6-glycinylcarbamoyladenosine | g6A | A | YES |
| N6-isopentenyladenosine | i6A | A | YES |
| N6-methyladenosine | m6A | A | YES |
| N6-threonylcarbamoyladenosine | t6A | A | YES |
| 1,2'-O-dimethyladenosine | m1Am | A | YES |
| 1-methyladenosine | m1A | A | YES |
| 2'-O-methyladenosine | Am | A | YES |
| 2'-O-ribosyladenosine (phosphate) | Ar(p) | A | YES |
| 2-methyladenosine | m2A | A | YES |
| 2-methylthio-N6 isopentenyladenosine | ms2i6A | A | YES |
| 2-methylthio-N6-hydroxynorvalyl carbamoyladenosine | ms2hn6A | A | YES |
| 2'-O-methyladenosine | m6A | A | YES |
| 2'-O-ribosyladenosine (phosphate) | Ar(p) | A | YES |
| Isopentenyladenosine | Iga | A | YES |
| N6-(cis-hydroxyisopentenyl)adenosine | io6A | A | YES |
| N6,2'-O-dimethyladenosine | m6Am | A | YES |
| $N^6$,2'-O-dimethyladenosine | $m^6$Am | A | YES |
| N6,N6,2'-O-trimethyladenosine | m62Am | A | YES |
| N6,N6-dimethyladenosine | m62A | A | YES |
| N6-acetyladenosine | ac6A | A | YES |
| N6-hydroxynorvalylcarba-moyladenosine | hn6A | A | YES |
| N6-methyl-N6-threonylcarbamoyladenosine | m6t6A | A | YES |
| 2-methyladenosine | $m^2$A | A | YES |
| 2-methylthio-$N^6$-isopentenyladenosine | $ms^2i^6$A | A | YES |
| 7-deaza-adenosine | — | A | NO |
| N1-methyl-adenosine | — | A | NO |
| N6,N6 (dimethyl)adenine | — | A | NO |
| N6-cis-hydroxy-isopentenyl-adenosine | — | A | NO |
| α-thio-adenosine | — | A | NO |
| 2 (amino)adenine | — | A | NO |
| 2 (aminopropyl)adenine | — | A | NO |
| 2 (methylthio) N6 (isopentenyl)adenine | — | A | NO |
| 2-(alkyl)adenine | — | A | NO |
| 2-(aminoalkyl)adenine | — | A | NO |
| 2-(aminopropyl)adenine | — | A | NO |
| 2-(halo)adenine | — | A | NO |
| 2-(halo)adenine | — | A | NO |
| 2-(propyl)adenine | — | A | NO |
| 2'-Amino-2'-deoxy-ATP | — | A | NO |
| 2'-Azido-2'-deoxy-ATP | — | A | NO |
| 2'-Deoxy-2'-a-aminoadenosine TP | — | A | NO |

TABLE 22-continued

| Modifications | | | |
|---|---|---|---|
| Name | Symbol | Base | Naturally Occurring |
| 2'-Deoxy-2'-a-azidoadenosine TP | — | A | NO |
| 6 (alkyl)adenine | — | A | NO |
| 6 (methyl)adenine | — | A | NO |
| 6-(alkyl)adenine | — | A | NO |
| 6-(methyl)adenine | — | A | NO |
| 7 (deaza)adenine | — | A | NO |
| 8 (alkenyl)adenine | — | A | NO |
| 8 (alkynyl)adenine | — | A | NO |
| 8 (amino)adenine | — | A | NO |
| 8 (thioalkyl)adenine | — | A | NO |
| 8-(alkenyl)adenine | — | A | NO |
| 8-(alkyl)adenine | — | A | NO |
| 8-(alkynyl)adenine | — | A | NO |
| 8-(amino)adenine | — | A | NO |
| 8-(halo)adenine | — | A | NO |
| 8-(hydroxyl)adenine | — | A | NO |
| 8-(thioalkyl)adenine | — | A | NO |
| 8-(thiol)adenine | — | A | NO |
| 8-azido-adenosine | — | A | NO |
| aza adenine | — | A | NO |
| deaza adenine | — | A | NO |
| N6 (methyl)adenine | — | A | NO |
| N6-(isopentyl)adenine | — | A | NO |
| 7-deaza-8-aza-adenosine | — | A | NO |
| 7-methyladenine | — | A | NO |
| 1-Deazaadenosine TP | — | A | NO |
| 2'Fluoro-N6-Bz-deoxyadenosine TP | — | A | NO |
| 2'-OMe-2-Amino-ATP | — | A | NO |
| 2'O-methyl-N6-Bz-deoxyadenosine TP | — | A | NO |
| 2'-a-Ethynyladenosine TP | — | A | NO |
| 2-aminoadenine | — | A | NO |
| 2-Aminoadenosine TP | — | A | NO |
| 2-Amino-ATP | — | A | NO |
| 2'-a-Trifluoromethyladenosine TP | — | A | NO |
| 2-Azidoadenosine TP | — | A | NO |
| 2'-b-Ethynyladenosine TP | — | A | NO |
| 2-Bromoadenosine TP | — | A | NO |
| 2'-b-Trifluoromethyladenosine TP | — | A | NO |
| 2-Chloroadenosine TP | — | A | NO |
| 2'-Deoxy-2',2'-difluoroadenosine TP | — | A | NO |
| 2'-Deoxy-2'-a-mercaptoadenosine TP | — | A | NO |
| 2'-Deoxy-2'-a-thiomethoxyadenosine TP | — | A | NO |
| 2'-Deoxy-2'-b-aminoadenosine TP | — | A | NO |
| 2'-Deoxy-2'-b-azidoadenosine TP | — | A | NO |
| 2'-Deoxy-2'-b-bromoadenosine TP | — | A | NO |
| 2'-Deoxy-2'-b-chloroadenosine TP | — | A | NO |
| 2'-Deoxy-2'-b-fluoroadenosine TP | — | A | NO |
| 2'-Deoxy-2'-b-iodoadenosine TP | — | A | NO |
| 2'-Deoxy-2'-b-mercaptoadenosine TP | — | A | NO |
| 2'-Deoxy-2'-b-thiomethoxyadenosine TP | — | A | NO |
| 2-Fluoroadenosine TP | — | A | NO |
| 2-Iodoadenosine TP | — | A | NO |
| 2-Mercaptoadenosine TP | — | A | NO |
| 2-methoxy-adenine | — | A | NO |
| 2-methylthio-adenine | — | A | NO |
| 2-Trifluoromethyladenosine TP | — | A | NO |
| 3-Deaza-3-bromoadenosine TP | — | A | NO |
| 3-Deaza-3-chloroadenosine TP | — | A | NO |
| 3-Deaza-3-fluoroadenosine TP | — | A | NO |
| 3-Deaza-3-iodoadenosine TP | — | A | NO |
| 3-Deazaadenosine TP | — | A | NO |
| 4'-Azidoadenosine TP | — | A | NO |
| 4'-Carbocyclic adenosine TP | — | A | NO |
| 4'-Ethynyladenosine TP | — | A | NO |
| 5'-Homo-adenosine TP | — | A | NO |
| 8-Aza-ATP | — | A | NO |
| 8-bromo-adenosine TP | — | A | NO |
| 8-Trifluoromethyladenosine TP | — | A | NO |
| 9-Deazaadenosine TP | — | A | NO |
| 2-aminopurine | — | A/G | NO |
| 7-deaza-2,6-diaminopurine | — | A/G | NO |
| 7-deaza-8-aza-2,6-diaminopurine | — | A/G | NO |
| 7-deaza-8-aza-2-aminopurine | — | A/G | NO |

TABLE 22-continued

Modifications

| Name | Symbol | Base | Naturally Occurring |
|---|---|---|---|
| 2,6-diaminopurine | — | A/G | NO |
| 7-deaza-8-aza-adenine, 7-deaza-2-aminopurine | — | A/G | NO |
| 2-thiocytidine | s2C | C | YES |
| 3-methylcytidine | m3C | C | YES |
| 5-formylcytidine | f5C | C | YES |
| 5-hydroxymethylcytidine | hm5C | C | YES |
| 5-methylcytidine | m5C | C | YES |
| N4-acetylcytidine | ac4C | C | YES |
| 2'-O-methylcytidine | Cm | C | YES |
| 2'-O-methylcytidine | Cm | C | YES |
| 5,2'-O-dimethylcytidine | m5 Cm | C | YES |
| 5-formyl-2'-O-methylcytidine | f5Cm | C | YES |
| Lysidine | k2C | C | YES |
| N4,2'-O-dimethylcytidine | m4Cm | C | YES |
| N4-acetyl-2'-O-methylcytidine | ac4Cm | C | YES |
| N4-methylcytidine | m4C | C | YES |
| N4,N4-Dimethyl-2'-OMe-Cytidine TP | — | C | YES |
| 4-methylcytidine | — | C | NO |
| 5-aza-cytidine | — | C | NO |
| Pseudo-iso-cytidine | — | C | NO |
| pyrrolo-cytidine | — | C | NO |
| α-thio-cytidine | — | C | NO |
| 2-(thio)cytosine | — | C | NO |
| 2'-Amino-2'-deoxy-CTP | — | C | NO |
| 2'-Azido-2'-deoxy-CTP | — | C | NO |
| 2'-Deoxy-2'-a-aminocytidine TP | — | C | NO |
| 2'-Deoxy-2'-a-azidocytidine TP | — | C | NO |
| 3 (deaza) 5 (aza)cytosine | — | C | NO |
| 3 (methyl)cytosine | — | C | NO |
| 3-(alkyl)cytosine | — | C | NO |
| 3-(deaza) 5 (aza)cytosine | — | C | NO |
| 3-(methyl)cytidine | — | C | NO |
| 4,2'-O-dimethylcytidine | — | C | NO |
| 5 (halo)cytosine | — | C | NO |
| 5 (methyl)cytosine | — | C | NO |
| 5 (propynyl)cytosine | — | C | NO |
| 5 (trifluoromethyl)cytosine | — | C | NO |
| 5-(alkyl)cytosine | — | C | NO |
| 5-(alkynyl)cytosine | — | C | NO |
| 5-(halo)cytosine | — | C | NO |
| 5-(propynyl)cytosine | — | C | NO |
| 5-(trifluoromethyl)cytosine | — | C | NO |
| 5-bromo-cytidine | — | C | NO |
| 5-iodo-cytidine | — | C | NO |
| 5-propynyl cytosine | — | C | NO |
| 6-(azo)cytosine | — | C | NO |
| 6-aza-cytidine | — | C | NO |
| aza cytosine | — | C | NO |
| deaza cytosine | — | C | NO |
| N4 (acetyl)cytosine | — | C | NO |
| 1-methyl-1-deaza-pseudoisocytidine | — | C | NO |
| 1-methyl-pseudoisocytidine | — | C | NO |
| 2-methoxy-5-methyl-cytidine | — | C | NO |
| 2-methoxy-cytidine | — | C | NO |
| 2-thio-5-methyl-cytidine | — | C | NO |
| 4-methoxy-1-methyl-pseudoisocytidine | — | C | NO |
| 4-methoxy-pseudoisocytidine | — | C | NO |
| 4-thio-1-methyl-1-deaza-pseudoisocytidine | — | C | NO |
| 4-thio-1-methyl-pseudoisocytidine | — | C | NO |
| 4-thio-pseudoisocytidine | — | C | NO |
| 5-aza-zebularine | — | C | NO |
| 5-methyl-zebularine | — | C | NO |
| pyrrolo-pseudoisocytidine | — | C | NO |
| Zebularine | — | C | NO |
| (E)-5-(2-Bromo-vinyl)cytidine TP | — | C | NO |
| 2,2'-anhydro-cytidine TP hydrochloride | — | C | NO |
| 2'Fluor-N4-Bz-cytidine TP | — | C | NO |
| 2'Fluoro-N4-Acetyl-cytidine TP | — | C | NO |
| 2'-O-Methyl-N4-Acetyl-cytidine TP | — | C | NO |
| 2'O-methyl-N4-Bz-cytidine TP | — | C | NO |
| 2'-a-Ethynylcytidine TP | — | C | NO |
| 2'-a-Trifluoromethylcytidine TP | — | C | NO |
| 2'-b-Ethynylcytidine TP | — | C | NO |
| 2'-b-Trifluoromethylcytidine TP | — | C | NO |
| 2'-Deoxy-2',2'-difluorocytidine TP | — | C | NO |
| 2'-Deoxy-2'-a-mercaptocytidine TP | — | C | NO |
| 2'-Deoxy-2'-a-thiomethoxycytidine TP | — | C | NO |
| 2'-Deoxy-2'-b-aminocytidine TP | — | C | NO |
| 2'-Deoxy-2'-b-azidocytidine TP | — | C | NO |
| 2'-Deoxy-2'-b-bromocytidine TP | — | C | NO |
| 2'-Deoxy-2'-b-chlorocytidine TP | — | C | NO |
| 2'-Deoxy-2'-b-fluorocytidine TP | — | C | NO |
| 2'-Deoxy-2'-b-iodocytidine TP | — | C | NO |
| 2'-Deoxy-2'-b-mercaptocytidine TP | — | C | NO |
| 2'-Deoxy-2'-b-thiomethoxycytidine TP | — | C | NO |
| 2'-O-Methyl-5-(1-propynyl)cytidine TP | — | C | NO |
| 3'-Ethynylcytidine TP | — | C | NO |
| 4'-Azidocytidine TP | — | C | NO |
| 4'-Carbocyclic cytidine TP | — | C | NO |
| 4'-Ethynylcytidine TP | — | C | NO |
| 5-(1-Propynyl)ara-cytidine TP | — | C | NO |
| 5-(2-Chloro-phenyl)-2-thiocytidine TP | — | C | NO |
| 5-(4-Amino-phenyl)-2-thiocytidine TP | — | C | NO |
| 5-Aminoallyl-CTP | — | C | NO |
| 5-Cyanocytidine TP | — | C | NO |
| 5-Ethynylara-cytidine TP | — | C | NO |
| 5-Ethynylcytidine TP | — | C | NO |
| 5'-Homo-cytidine TP | — | C | NO |
| 5-Methoxycytidine TP | — | C | NO |
| 5-Trifluoromethyl-Cytidine TP | — | C | NO |
| N4-Amino-cytidine TP | — | C | NO |
| N4-Benzoyl-cytidine TP | — | C | NO |
| Pseudoisocytidine | — | C | NO |
| 7-methylguanosine | m7G | G | YES |
| N2,2'-O-dimethylguanosine | m2Gm | G | YES |
| N2-methylguanosine | m2G | G | YES |
| Wyosine | imG | G | YES |
| 1,2'-O-dimethylguanosine | m1Gm | G | YES |
| 1-methylguanosine | m1G | G | YES |
| 2'-O-methylguanosine | Gm | G | YES |
| 2'-O-ribosylguanosine (phosphate) | Gr(p) | G | YES |
| 2'-O-methylguanosine | Gm | G | YES |
| 2'-O-ribosylguanosine (phosphate) | Gr(p) | G | YES |
| 7-aminomethyl-7-deazaguanosine | preQ1 | G | YES |
| 7-cyano-7-deazaguanosine | preQ0 | G | YES |
| Archaeosine | G+ | G | YES |
| Methylwyosine | mimG | G | YES |
| N2,7-dimethylguanosine | m2,7G | G | YES |
| N2,N2,2'-O-trimethylguanosine | m22Gm | G | YES |
| N2,N2,7-trimethylguanosine | m2,2,7G | G | YES |
| N2,N2-dimethylguanosine | m22G | G | YES |
| $N^{2,7,2'}$-O-trimethylguanosine | $m^{2,7}Gm$ | G | YES |
| 6-thio-guanosine | — | G | NO |
| 7-deaza-guanosine | — | G | NO |
| 8-oxo-guanosine | — | G | NO |
| N1-methyl-guanosine | — | G | NO |
| α-thio-guanosine | — | G | NO |
| 2 (propyl)guanine | — | G | NO |
| 2-(alkyl)guanine | — | G | NO |
| 2'-Amino-2'-deoxy-GTP | — | G | NO |
| 2'-Azido-2'-deoxy-GTP | — | G | NO |
| 2'-Deoxy-2'-a-aminoguanosine TP | — | G | NO |
| 2'-Deoxy-2'-a-azidoguanosine TP | — | G | NO |
| 6 (methyl)guanine | — | G | NO |
| 6-(alkyl)guanine | — | G | NO |
| 6-(methyl)guanine | — | G | NO |
| 6-methyl-guanosine | — | G | NO |
| 7 (alkyl)guanine | — | G | NO |
| 7 (deaza)guanine | — | G | NO |
| 7 (methyl)guanine | — | G | NO |
| 7-(alkyl)guanine | — | G | NO |
| 7-(deaza)guanine | — | G | NO |
| 7-(methyl)guanine | — | G | NO |
| 8 (alkyl)guanine | — | G | NO |
| 8 (alkynyl)guanine | — | G | NO |
| 8 (halo)guanine | — | G | NO |
| 8 (thioalkyl)guanine | — | G | NO |
| 8-(alkenyl)guanine | — | G | NO |

TABLE 22-continued

Modifications

| Name | Symbol | Base | Naturally Occurring |
|---|---|---|---|
| 8-(alkyl)guanine | — | G | NO |
| 8-(alkynyl)guanine | — | G | NO |
| 8-(amino)guanine | — | G | NO |
| 8-(halo)guanine | — | G | NO |
| 8-(hydroxyl)guanine | — | G | NO |
| 8-(thioalkyl)guanine | — | G | NO |
| 8-(thiol)guanine | — | G | NO |
| aza guanine | — | G | NO |
| deaza guanine | — | G | NO |
| N (methyl)guanine | — | G | NO |
| N-(methyl)guanine | — | G | NO |
| 1-methyl-6-thio-guanosine | — | G | NO |
| 6-methoxy-guanosine | — | G | NO |
| 6-thio-7-deaza-8-aza-guanosine | — | G | NO |
| 6-thio-7-deaza-guanosine | — | G | NO |
| 6-thio-7-methyl-guanosine | — | G | NO |
| 7-deaza-8-aza-guanosine | — | G | NO |
| 7-methyl-8-oxo-guanosine | — | G | NO |
| N2,N2-dimethyl-6-thio-guanosine | — | G | NO |
| N2-methyl-6-thio-guanosine | — | G | NO |
| 1-Me-GTP | — | G | NO |
| 2'Fluoro-N2-isobutyl-guanosine TP | — | G | NO |
| 2'O-methyl-N2-isobutyl-guanosine TP | — | G | NO |
| 2'-a-Ethynylguanosine TP | — | G | NO |
| 2'-a-Trifluoromethylguanosine TP | — | G | NO |
| 2'-b-Ethynylguanosine TP | — | G | NO |
| 2'-b-Trifluoromethylguanosine TP | — | G | NO |
| 2'-Deoxy-2',2'-difluoroguanosine TP | — | G | NO |
| 2'-Deoxy-2'-a-mercaptoguanosine TP | — | G | NO |
| 2'-Deoxy-2'-a-thiomethoxyguanosine TP | — | G | NO |
| 2'-Deoxy-2'-b-aminoguanosine TP | — | G | NO |
| 2'-Deoxy-2'-b-azidoguanosine TP | — | G | NO |
| 2'-Deoxy-2'-b-bromoguanosine TP | — | G | NO |
| 2'-Deoxy-2'-b-chloroguanosine TP | — | G | NO |
| 2'-Deoxy-2'-b-fluoroguanosine TP | — | G | NO |
| 2'-Deoxy-2'-b-iodoguanosine TP | — | G | NO |
| 2'-Deoxy-2'-b-mercaptoguanosine TP | — | G | NO |
| 2'-Deoxy-2'-b-thiomethoxyguanosine TP | — | G | NO |
| 4'-Azidoguanosine TP | — | G | NO |
| 4'-Carbocyclic guanosine TP | — | G | NO |
| 4'-Ethynylguanosine TP | — | G | NO |
| 5'-Homo-guanosine TP | — | G | NO |
| 8-bromo-guanosine TP | — | G | NO |
| 9-Deazaguanosine TP | — | G | NO |
| N2-isobutyl-guanosine TP | — | G | NO |
| 1-methylinosine | m1I | I | YES |
| Inosine | I | I | YES |
| 1,2'-O-dimethylinosine | m1Im | I | YES |
| 2'-O-methylinosine | Im | I | YES |
| 7-methylinosine | | I | NO |
| 2'-O-methylinosine | Im | I | YES |
| Epoxyqueuosine | oQ | Q | YES |
| galactosyl-queuosine | galQ | Q | YES |
| Mannosylqueuosine | manQ | Q | YES |
| Queuosine | Q | Q | YES |
| allyamino-thymidine | — | T | NO |
| aza thymidine | — | T | NO |
| deaza thymidine | — | T | NO |
| deoxy-thymidine | — | T | NO |
| 2'-O-methyluridine | — | U | YES |
| 2-thiouridine | s2U | U | YES |
| 3-methyluridine | m3U | U | YES |
| 5-carboxymethyluridine | cm5U | U | YES |
| 5-hydroxyuridine | ho5U | U | YES |
| 5-methyluridine | m5U | U | YES |
| 5-taurinomethyl-2-thiouridine | τm5s2U | U | YES |
| 5-taurinomethyluridine | τm5U | U | YES |
| Dihydrouridine | D | U | YES |
| Pseudouridine | Ψ | U | YES |
| (3-(3-amino-3-carboxypropyl)uridine | acp3U | U | YES |
| 1-methyl-3-(3-amino-5-carboxypropyl)pseudouridine | m1acp3Ψ | U | YES |
| 1-methylpseudouridine | m1Ψ | U | YES |
| 1-methyl-pseudouridine | — | U | YES |
| 2'-O-methyluridine | Um | U | YES |
| 2'-O-methylpseudouridine | Ψm | U | YES |
| 2'-O-methyluridine | Um | U | YES |
| 2-thio-2'-O-methyluridine | s2Um | U | YES |
| 3-(3-amino-3-carboxypropyl)uridine | acp3U | U | YES |
| 3,2'-O-dimethyluridine | m3Um | U | YES |
| 3-Methyl-pseudo-Uridine TP | — | U | YES |
| 4-thiouridine | s4U | U | YES |
| 5-(carboxyhydroxymethyl)uridine | chm5U | U | YES |
| 5-(carboxyhydroxymethyl)uridine methyl ester | mchm5U | U | YES |
| 5,2'-O-dimethyluridine | m5Um | U | YES |
| 5,6-dihydro-uridine | — | U | YES |
| 5-aminomethyl-2-thiouridine | nm5s2U | U | YES |
| 5-carbamoylmethyl-2'-O-methyluridine | ncm5Um | U | YES |
| 5-carbamoylmethyluridine | ncm5U | U | YES |
| 5-carboxyhydroxymethyluridine | — | U | YES |
| 5-carboxyhydroxymethyluridine methyl ester | — | U | YES |
| 5-carboxymethylaminomethyl-2'-O-methyluridine | cmnm5Um | U | YES |
| 5-carboxymethylaminomethyl-2-thiouridine | cmnm5s2U | U | YES |
| 5-carboxymethylaminomethyl-2-thiouridine | — | U | YES |
| 5-carboxymethylaminomethyluridine | cmnm5U | U | YES |
| 5-carboxymethylaminomethyluridine | — | U | YES |
| 5-Carbamoylmethyluridine TP | — | U | YES |
| 5-methoxycarbonylmethyl-2'-O-methyluridine | mcm5Um | U | YES |
| 5-methoxycarbonylmethyl-2-thiouridine | mcm5s2U | U | YES |
| 5-methoxycarbonylmethyluridine | mcm5U | U | YES |
| 5-methoxyuridine | mo5U | U | YES |
| 5-methyl-2-thiouridine | m5s2U | U | YES |
| 5-methylaminomethyl-2-selenouridine | mnm5se2U | U | YES |
| 5-methylaminomethyl-2-thiouridine | mnm5s2U | U | YES |
| 5-methylaminomethyluridine | mnm5U | U | YES |
| 5-Methyldihydrouridine | — | U | YES |
| 5-Oxyacetic acid-Uridine TP | — | U | YES |
| 5-Oxyacetic acid-methyl ester-Uridine TP | — | U | YES |
| N1-methyl-pseudo-uridine | — | U | YES |
| uridine 5-oxyacetic acid | cmo5U | U | YES |
| uridine 5-oxyacetic acid methyl ester | mcmo5U | U | YES |
| 3-(3-Amino-3-carboxypropyl)-Uridine TP | — | U | YES |
| 5-(iso-Pentenylaminomethyl)-2-thiouridine TP | — | U | YES |
| 5-(iso-Pentenylaminomethyl)-2'-O-methyluridine TP | — | U | YES |
| 5-(iso-Pentenylaminomethyl)uridine TP | — | U | YES |
| 5-propynyl uracil | — | U | NO |
| α-thio-uridine | — | U | NO |
| 1 (aminoalkylamino-carbonylethylenyl)-2(thio)-pseudouracil | — | U | NO |
| 1 (aminoalkylaminocarbonylethylenyl)-2,4-(dithio)pseudouracil | — | U | NO |
| 1 (aminoalkylaminocarbonyl-ethylenyl)-4(thio)pseudouracil | — | U | NO |
| 1 (aminoalkylaminocarbonylethylenyl)-pseudouracil | — | U | NO |
| 1 (aminocarbonylethylenyl)-2(thio)-pseudouracil | — | U | NO |
| 1 (aminocarbonylethylenyl)-2,4-(dithio)pseudouracil | — | U | NO |
| 1 (aminocarbonylethylenyl)-4 (thio)pseudouracil | — | U | NO |
| 1 (aminocarbonylethylenyl)-pseudouracil | — | U | NO |
| 1 substituted 2(thio)-pseudouracil | — | U | NO |
| 1 substituted 2,4-(dithio)pseudouracil | — | U | NO |
| 1 substituted 4 (thio)pseudouracil | — | U | NO |
| 1 substituted pseudouracil | — | U | NO |

TABLE 22-continued

Modifications

| Name | Symbol | Base | Naturally Occurring |
|---|---|---|---|
| 1-(aminoalkylamino-carbonylethylenyl)-2-(thio)-pseudouracil | — | U | NO |
| 1-Methyl-3-(3-amino-3-carboxypropyl) pseudouridine TP | — | U | NO |
| 1-Methyl-3-(3-amino-3-carboxypropyl)pseudo-UTP | — | U | NO |
| 1-Methyl-pseudo-UTP | — | U | NO |
| 2 (thio)pseudouracil | — | U | NO |
| 2' deoxy uridine | — | U | NO |
| 2' fluorouridine | — | U | NO |
| 2-(thio)uracil | — | U | NO |
| 2,4-(dithio)psuedouracil | — | U | NO |
| 2' methyl, 2'amino, 2'azido, 2'fluoro-guanosine | — | U | NO |
| 2'-Amino-2'-deoxy-UTP | — | U | NO |
| 2'-Azido-2'-deoxy-UTP | — | U | NO |
| 2'-Azido-deoxyuridine TP | — | U | NO |
| 2'-O-methylpseudouridine | — | U | NO |
| 2' deoxy uridine | 2' dU | U | NO |
| 2' fluorouridine | — | U | NO |
| 2'-Deoxy-2'-a-aminouridine TP | — | U | NO |
| 2'-Deoxy-2'-a-azidouridine TP | — | U | NO |
| 2-methylpseudouridine | m3Ψ | U | NO |
| 3 (3 amino-3 carboxypropyl)uracil | — | U | NO |
| 4 (thio)pseudouracil | — | U | NO |
| 4-(thio)pseudouracil | — | U | NO |
| 4-(thio)uracil | — | U | NO |
| 4-thiouracil | — | U | NO |
| 5 (1,3-diazole-1-alkyl)uracil | — | U | NO |
| 5 (2-aminopropyl)uracil | — | U | NO |
| 5 (aminoalkyl)uracil | — | U | NO |
| 5 (dimethylaminoalkyl)uracil | — | U | NO |
| 5 (guanidiniumalkyl)uracil | — | U | NO |
| 5 (methoxycarbonylmethyl)-2-(thio)uracil | — | U | NO |
| 5 (methoxycarbonyl-methyl)uracil | — | U | NO |
| 5 (methyl) 2 (thio)uracil | — | U | NO |
| 5 (methyl) 2,4 (dithio)uracil | — | U | NO |
| 5 (methyl) 4(thio)uracil | — | U | NO |
| 5 (methylaminomethyl)-2 (thio)uracil | — | U | NO |
| 5 (methylaminomethyl)-2,4(dithio)uracil | — | U | NO |
| 5 (methylaminomethyl)-4 (thio)uracil | — | U | NO |
| 5 (propynyl)uracil | — | U | NO |
| 5 (trifluoromethyl)uracil | — | U | NO |
| 5-(2-aminopropyl)uracil | — | U | NO |
| 5-(alkyl)-2-(thio)pseudouracil | — | U | NO |
| 5-(alkyl)-2,4 (dithio)pseudouracil | — | U | NO |
| 5-(alkyl)-4 (thio)pseudouracil | — | U | NO |
| 5-(alkyl)pseudouracil | — | U | NO |
| 5-(alkyl)uracil | — | U | NO |
| 5-(alkynyl)uracil | — | U | NO |
| 5-(allylamino)uracil | — | U | NO |
| 5-(cyanoalkyl)uracil | — | U | NO |
| 5-(dialkylaminoalkyl)uracil | — | U | NO |
| 5-(dimethylaminoalkyl)uracil | — | U | NO |
| 5-(guanidiniumalkyl)uracil | — | U | NO |
| 5-(halo)uracil | — | U | NO |
| 5-(1,3-diazole-1-alkyl)uracil | — | U | NO |
| 5-(methoxy)uracil | — | U | NO |
| 5-(methoxycarbonylmethyl)-2-(thio)uracil | — | U | NO |
| 5-(methoxycarbonyl-methyl)uracil | — | U | NO |
| 5-(methyl) 2(thio)uracil | — | U | NO |
| 5-(methyl) 2,4 (dithio)uracil | — | U | NO |
| 5-(methyl) 4 (thio)uracil | — | U | NO |
| 5-(methyl)-2-(thio)pseudouracil | — | U | NO |
| 5-(methyl)-2,4 (dithio)pseudouracil | — | U | NO |
| 5-(methyl)-4 (thio)pseudouracil | — | U | NO |
| 5-(methyl)pseudouracil | — | U | NO |
| 5-(methylaminomethyl)-2 (thio)uracil | — | U | NO |
| 5-(methylaminomethyl)-2,4(dithio)uracil | — | U | NO |
| 5-(methylaminomethyl)-4-(thio)uracil | — | U | NO |
| 5-(propynyl)uracil | — | U | NO |
| 5-(trifluoromethyl)uracil | — | U | NO |
| 5-aminoallyl-uridine | — | U | NO |
| 5-bromo-uridine | — | U | NO |
| 5-iodo-uridine | — | U | NO |
| 5-uracil | — | U | NO |
| 6 (azo)uracil | — | U | NO |
| 6-(azo)uracil | — | U | NO |
| 6-aza-uridine | — | U | NO |
| allyamino-uracil | — | U | NO |
| aza uracil | — | U | NO |
| deaza uracil | — | U | NO |
| N3 (methyl)uracil | — | U | NO |
| Pseudo-UTP-1-2-ethanoic acid | — | U | NO |
| Pseudouracil | — | U | NO |
| 4-Thio-pseudo-UTP | — | U | NO |
| 1-carboxymethyl-pseudouridine | — | U | NO |
| 1-methyl-1-deaza-pseudouridine | — | U | NO |
| 1-propynyl-uridine | — | U | NO |
| 1-taurinomethyl-1-methyl-uridine | — | U | NO |
| 1-taurinomethyl-4-thio-uridine | — | U | NO |
| 1-taurinomethyl-pseudouridine | — | U | NO |
| 2-methoxy-4-thio-pseudouridine | — | U | NO |
| 2-thio-1-methyl-1-deaza-pseudouridine | — | U | NO |
| 2-thio-1-methyl-pseudouridine | — | U | NO |
| 2-thio-5-aza-uridine | — | U | NO |
| 2-thio-dihydropseudouridine | — | U | NO |
| 2-thio-dihydrouridine | — | U | NO |
| 2-thio-pseudouridine | — | U | NO |
| 4-methoxy-2-thio-pseudouridine | — | U | NO |
| 4-methoxy-pseudouridine | — | U | NO |
| 4-thio-1-methyl-pseudouridine | — | U | NO |
| 4-thio-pseudouridine | — | U | NO |
| 5-aza-uridine | — | U | NO |
| Dihydropseudouridine | — | U | NO |
| (±)1-(2-Hydroxypropyl)pseudouridine TP | — | U | NO |
| (2R)-1-(2-Hydroxypropyl)pseudouridine TP | — | U | NO |
| (2S)-1-(2-Hydroxypropyl)pseudouridine TP | — | U | NO |
| (E)-5-(2-Bromo-vinyl)ara-uridine TP | — | U | NO |
| (E)-5-(2-Bromo-vinyl)uridine TP | — | U | NO |
| (Z)-5-(2-Bromo-vinyl)ara-uridine TP | — | U | NO |
| (Z)-5-(2-Bromo-vinyl)uridine TP | — | U | NO |
| 1-(2,2,2-Trifluoroethyl)-pseudo-UTP | — | U | NO |
| 1-(2,2,3,3,3-Pentafluoropropyl)pseudouridine TP | — | U | NO |
| 1-(2,2-Diethoxyethyl)pseudouridine TP | — | U | NO |
| 1-(2,4,6-Trimethylbenzyl)pseudouridine TP | — | U | NO |
| 1-(2,4,6-Trimethyl-benzyl)pseudo-UTP | — | U | NO |
| 1-(2,4,6-Trimethyl-phenyl)pseudo-UTP | — | U | NO |
| 1-(2-Amino-2-carboxyethyl)pseudo-UTP | — | U | NO |
| 1-(2-Amino-ethyl)pseudo-UTP | — | U | NO |
| 1-(2-Hydroxyethyl)pseudouridine TP | — | U | NO |
| 1-(2-Methoxyethyl)pseudouridine TP | — | U | NO |
| 1-(3,4-Bis-trifluoro-methoxybenzyl)pseudouridine TP | — | U | NO |
| 1-(3,4-Dimethoxybenzyl)pseudouridine TP | — | U | NO |
| 1-(3-Amino-3-carboxypropyl)pseudo-UTP | — | U | NO |
| 1-(3-Amino-propyl)pseudo-UTP | — | U | NO |
| 1-(3-Cyclopropyl-prop-2-ynyl)pseudouridine TP | — | U | NO |
| 1-(4-Amino-4-carboxybutyl)pseudo-UTP | — | U | NO |
| 1-(4-Amino-benzyl)pseudo-UTP | — | U | NO |
| 1-(4-Amino-butyl)pseudo-UTP | — | U | NO |
| 1-(4-Amino-phenyl)pseudo-UTP | — | U | NO |
| 1-(4-Azidobenzyl)pseudouridine TP | — | U | NO |
| 1-(4-Bromobenzyl)pseudouridine TP | — | U | NO |
| 1-(4-Chlorobenzyl)pseudouridine TP | — | U | NO |
| 1-(4-Fluorobenzyl)pseudouridine TP | — | U | NO |

TABLE 22-continued

Modifications

| Name | Symbol | Base | Naturally Occurring |
|---|---|---|---|
| 1-(4-Iodobenzyl)pseudouridine TP | — | U | NO |
| 1-(4-Methane-sulfonylbenzyl)pseudouridine TP | — | U | NO |
| 1-(4-Methoxybenzyl)pseudouridine TP | — | U | NO |
| 1-(4-Methoxy-benzyl)pseudo-UTP | — | U | NO |
| 1-(4-Methoxy-phenyl)pseudo-UTP | — | U | NO |
| 1-(4-Methylbenzyl)pseudouridine TP | — | U | NO |
| 1-(4-Methyl-benzyl)pseudo-UTP | — | U | NO |
| 1-(4-Nitrobenzyl)pseudouridine TP | — | U | NO |
| 1-(4-Nitro-benzyl)pseudo-UTP | — | U | NO |
| 1(4-Nitro-phenyl)pseudo-UTP | — | U | NO |
| 1-(4-Thiomethoxybenzyl)pseudouridine TP | — | U | NO |
| 1-(4-Trifluoro-methoxybenzyl)pseudouridine TP | — | U | NO |
| 1-(4-Trifluoromethyl-benzyl)pseudouridine TP | — | U | NO |
| 1-(5-Amino-pentyl)pseudo-UTP | — | U | NO |
| 1-(6-Amino-hexyl)pseudo-UTP | — | U | NO |
| 1,6-Dimethyl-pseudo-UTP | — | U | NO |
| 1-[3-(2-{2-[2-(2-Aminoethoxy)-ethoxy]-ethoxy}-ethoxy)-propionyl]pseudo-uridine TP | — | U | NO |
| 1-{3-[2-(2-Aminoethoxy)-ethoxy]-propionyl} pseudouridine TP | — | U | NO |
| 1-Acetylpseudouridine TP | — | U | NO |
| 1-Alkyl-6-(1-propynyl)-pseudo-UTP | — | U | NO |
| 1-Alkyl-6-(2-propynyl)-pseudo-UTP | — | U | NO |
| 1-Alkyl-6-allyl-pseudo-UTP | — | U | NO |
| 1-Alkyl-6-ethynyl-pseudo-UTP | — | U | NO |
| 1-Alkyl-6-homoallyl-pseudo-UTP | — | U | NO |
| 1-Alkyl-6-vinyl-pseudo-UTP | — | U | NO |
| 1-Allylpseudouridine TP | — | U | NO |
| 1-Aminomethyl-pseudo-UTP | — | U | NO |
| 1-Benzoylpseudouridine TP | — | U | NO |
| 1-Benzyloxymethylpseudouridine TP | — | U | NO |
| 1-Benzyl-pseudo-UTP | — | U | NO |
| 1-Biotinyl-PEG2-pseudouridine TP | — | U | NO |
| 1-Biotinylpseudouridine TP | — | U | NO |
| 1-Butyl-pseudo-UTP | — | U | NO |
| 1-Cyanomethylpseudouridine TP | — | U | NO |
| 1-Cyclobutylmethyl-pseudo-UTP | — | U | NO |
| 1-Cyclobutyl-pseudo-UTP | — | U | NO |
| 1-Cycloheptylmethyl-pseudo-UTP | — | U | NO |
| 1-Cycloheptyl-pseudo-UTP | — | U | NO |
| 1-Cyclohexylmethyl-pseudo-UTP | — | U | NO |
| 1-Cyclohexyl-pseudo-UTP | — | U | NO |
| 1-Cyclooctylmethyl-pseudo-UTP | — | U | NO |
| 1-Cyclooctyl-pseudo-UTP | — | U | NO |
| 1-Cyclopentylmethyl-pseudo-UTP | — | U | NO |
| 1-Cyclopentyl-pseudo-UTP | — | U | NO |
| 1-Cyclopropylmethyl-pseudo-UTP | — | U | NO |
| 1-Cyclopropyl-pseudo-UTP | — | U | NO |
| 1-Ethyl-pseudo-UTP | — | U | NO |
| 1-Hexyl-pseudo-UTP | — | U | NO |
| 1-Homoallylpseudouridine TP | — | U | NO |
| 1-Hydroxymethylpseudouridine TP | — | U | NO |
| 1-iso-propyl-pseudo-UTP | — | U | NO |
| 1-Me-2-thio-pseudo-UTP | — | U | NO |
| 1-Me-4-thio-pseudo-UTP | — | U | NO |
| 1-Me-alpha-thio-pseudo-UTP | — | U | NO |
| 1-Methanesulfonylmethylpseudouridine TP | — | U | NO |
| 1-Methoxymethylpseudouridine TP | — | U | NO |
| 1-Methyl-6-(2,2,2-Trifluoro-ethyl)pseudo-UTP | — | U | NO |
| 1-Methyl-6-(4-morpholino)-pseudo-UTP | — | U | NO |
| 1-Methyl-6-(4-thiomorpholino)-pseudo-UTP | — | U | NO |
| 1-Methyl-6-(substituted phenyl)pseudo-UTP | — | U | NO |
| 1-Methyl-6-amino-pseudo-UTP | — | U | NO |
| 1-Methyl-6-azido-pseudo-UTP | — | U | NO |
| 1-Methyl-6-bromo-pseudo-UTP | — | U | NO |
| 1-Methyl-6-butyl-pseudo-UTP | — | U | NO |
| 1-Methyl-6-chloro-pseudo-UTP | — | U | NO |
| 1-Methyl-6-cyano-pseudo-UTP | — | U | NO |
| 1-Methyl-6-dimethylamino-pseudo-UTP | — | U | NO |
| 1-Methyl-6-ethoxy-pseudo-UTP | — | U | NO |
| 1-Methyl-6-ethylcarboxylate-pseudo-UTP | — | U | NO |
| 1-Methyl-6-ethyl-pseudo-UTP | — | U | NO |
| 1-Methyl-6-fluoro-pseudo-UTP | — | U | NO |
| 1-Methyl-6-formyl-pseudo-UTP | — | U | NO |
| 1-Methyl-6-hydroxyamino-pseudo-UTP | — | U | NO |
| 1-Methyl-6-hydroxy-pseudo-UTP | — | U | NO |
| 1-Methyl-6-iodo-pseudo-UTP | — | U | NO |
| 1-Methyl-6-iso-propyl-pseudo-UTP | — | U | NO |
| 1-Methyl-6-methoxy-pseudo-UTP | — | U | NO |
| 1-Methyl-6-methylamino-pseudo-UTP | — | U | NO |
| 1-Methyl-6-phenyl-pseudo-UTP | — | U | NO |
| 1-Methyl-6-propyl-pseudo-UTP | — | U | NO |
| 1-Methyl-6-tert-butyl-pseudo-UTP | — | U | NO |
| 1-Methyl-6-trifluoromethoxy-pseudo-UTP | — | U | NO |
| 1-Methyl-6-trifluoromethyl-pseudo-UTP | — | U | NO |
| 1-Morpholinomethylpseudouridine TP | — | U | NO |
| 1-Pentyl-pseudo-UTP | — | U | NO |
| 1-Phenyl-pseudo-UTP | — | U | NO |
| 1-Pivaloylpseudouridine TP | — | U | NO |
| 1-Propargylpseudouridine TP | — | U | NO |
| 1-Propyl-pseudo-UTP | — | U | NO |
| 1-propynyl-pseudouridine | — | U | NO |
| 1-p-tolyl-pseudo-UTP | — | U | NO |
| 1-tert-Butyl-pseudo-UTP | — | U | NO |
| 1-Thiomethoxymethylpseudouridine TP | — | U | NO |
| 1-Thiomorpholinomethylpseudouridine TP | — | U | NO |
| 1-Trifluoroacetylpseudouridine TP | — | U | NO |
| 1-Trifluoromethyl-pseudo-UTP | — | U | NO |
| 1-Vinylpseudouridine TP | — | U | NO |
| 2,2'-anhydro-uridine TP | — | U | NO |
| 2'-bromo-deoxyuridine TP | — | U | NO |
| 2'-F-5-Methyl-2'-deoxy-UTP | — | U | NO |
| 2'-OMe-5-Me-UTP | — | U | NO |
| 2'-OMe-pseudo-UTP | — | U | NO |
| 2'-a-Ethynyluridine TP | — | U | NO |
| 2'-a-Trifluoromethyluridine TP | — | U | NO |
| 2'-b-Ethynyluridine TP | — | U | NO |
| 2'-b-Trifluoromethyluridine TP | — | U | NO |
| 2'-Deoxy-2',2'-difluorouridine TP | — | U | NO |
| 2'-Deoxy-2'-a-mercaptouridine TP | — | U | NO |
| 2'-Deoxy-2'-a-thiomethoxyuridine TP | — | U | NO |
| 2'-Deoxy-2'-b-aminouridine TP | — | U | NO |
| 2'-Deoxy-2'-b-azidouridine TP | — | U | NO |
| 2'-Deoxy-2'-b-bromouridine TP | — | U | NO |
| 2'-Deoxy-2'-b-chlorouridine TP | — | U | NO |
| 2'-Deoxy-2'-b-fluorouridine TP | — | U | NO |
| 2'-Deoxy-2'-b-iodouridine TP | — | U | NO |
| 2'-Deoxy-2'-b-mercaptouridine TP | — | U | NO |
| 2'-Deoxy-2'-b-thiomethoxyuridine TP | — | U | NO |
| 2-methoxy-4-thio-uridine | — | U | NO |
| 2-methoxyuridine | — | U | NO |
| 2'-O-Methyl-5-(1-propynyl)uridine TP | — | U | NO |
| 3-Alkyl-pseudo-UTP | — | U | NO |
| 4'-Azidouridine TP | — | U | NO |
| 4'-Carbocyclic uridine TP | — | U | NO |
| 4'-Ethynyluridine TP | — | U | NO |
| 5-(1-Propynyl)ara-uridine TP | — | U | NO |
| 5-(2-Furanyl)uridine TP | — | U | NO |
| 5-Cyanouridine TP | — | U | NO |
| 5-Dimethylaminouridine TP | — | U | NO |
| 5'-Homo-uridine TP | — | U | NO |
| 5-iodo-2'-fluoro-deoxyuridine TP | — | U | NO |
| 5-Phenylethynyluridine TP | — | U | NO |
| 5-Trideuteromethyl-6-deuterouridine TP | — | U | NO |
| 5-Trifluoromethyl-Uridine TP | — | U | NO |
| 5-Vinylarauridine TP | — | U | NO |

TABLE 22-continued

Modifications

| Name | Symbol | Base | Naturally Occurring |
|---|---|---|---|
| 6-(2,2,2-Trifluoroethyl)-pseudo-UTP | — | U | NO |
| 6-(4-Morpholino)-pseudo-UTP | — | U | NO |
| 6-(4-Thiomorpholino)-pseudo-UTP | — | U | NO |
| 6-(Substituted-Phenyl)-pseudo-UTP | — | U | NO |
| 6-Amino-pseudo-UTP | — | U | NO |
| 6-Azido-pseudo-UTP | — | U | NO |
| 6-Bromo-pseudo-UTP | — | U | NO |
| 6-Butyl-pseudo-UTP | — | U | NO |
| 6-Chloro-pseudo-UTP | — | U | NO |
| 6-Cyano-pseudo-UTP | — | U | NO |
| 6-Dimethylamino-pseudo-UTP | — | U | NO |
| 6-Ethoxy-pseudo-UTP | — | U | NO |
| 6-Ethylcarboxylate-pseudo-UTP | — | U | NO |
| 6-Ethyl-pseudo-UTP | — | U | NO |
| 6-Fluoro-pseudo-UTP | — | U | NO |
| 6-Formyl-pseudo-UTP | — | U | NO |
| 6-Hydroxyamino-pseudo-UTP | — | U | NO |
| 6-Hydroxy-pseudo-UTP | — | U | NO |
| 6-Iodo-pseudo-UTP | — | U | NO |
| 6-iso-Propyl-pseudo-UTP | — | U | NO |
| 6-Methoxy-pseudo-UTP | — | U | NO |
| 6-Methylamino-pseudo-UTP | — | U | NO |
| 6-Methyl-pseudo-UTP | — | U | NO |
| 6-Phenyl-pseudo-UTP | — | U | NO |
| 6-Phenyl-pseudo-UTP | — | U | NO |
| 6-Propyl-pseudo-UTP | — | U | NO |
| 6-tert-Butyl-pseudo-UTP | — | U | NO |
| 6-Trifluoromethoxy-pseudo-UTP | — | U | NO |
| 6-Trifluoromethyl-pseudo-UTP | — | U | NO |
| Alpha-thio-pseudo-UTP | — | U | NO |
| Pseudouridine 1-(4-methylbenzene-sulfonic acid) TP | — | U | NO |
| Pseudouridine 1-(4-methylbenzoic acid) TP | — | U | NO |
| Pseudouridine TP 1-[3-(2-ethoxy)]propionic acid | — | U | NO |
| Pseudouridine TP 1-[3-{2-(2-[2-(2-ethoxy)-ethoxy]-ethoxy)-ethoxy}]propionic acid | — | U | NO |
| Pseudouridine TP 1-[3-{2-(2-[2-{2(2-ethoxy)-ethoxy}-ethoxy]-ethoxy)-ethoxy}]propionic acid | — | U | NO |
| Pseudouridine TP 1-[3-{2-(2-[2-ethoxy]-ethoxy)-ethoxy}]propionic acid | — | U | NO |
| Pseudouridine TP 1-[3-{2-(2-ethoxy)-ethoxy}] propionic acid | — | U | NO |
| Pseudouridine TP 1-methylphosphonic acid | — | U | NO |
| Pseudouridine TP 1-methylphosphonic acid diethyl ester | — | U | NO |
| Pseudo-UTP-N1-3-propionic acid | — | U | NO |
| Pseudo-UTP-N1-4-butanoic acid | — | U | NO |
| Pseudo-UTP-N1-5-pentanoic acid | — | U | NO |
| Pseudo-UTP-N1-6-hexanoic acid | — | U | NO |
| Pseudo-UTP-N1-7-heptanoic acid | — | U | NO |
| Pseudo-UTP-N1-methyl-p-benzoic acid | — | U | NO |
| Pseudo-UTP-N1-p-benzoic acid | — | U | NO |
| Wybutosine | yW | W | YES |
| Hydroxywybutosine | OHyW | W | YES |
| Isowyosine | imG2 | W | YES |
| Peroxywybutosine | o2yW | W | YES |
| undermodified hydroxywybutosine | OHyW* | W | YES |
| 4-demethylwyosine | imG-14 | W | YES |

Other modifications which may be useful in the polynucleotides of the NAVs of the present invention are listed in Table 23.

TABLE 23

Additional Modification types

| Name | Type |
|---|---|
| 2,6-(diamino)purine | Other |
| 1-(aza)-2-(thio)-3-(aza)-phenoxazin-1-yl | Other |
| 1,3-(diaza)-2-(oxo)-phenthiazin-1-yl | Other |
| 1,3-(diaza)-2-(oxo)-phenoxazin-1-yl | Other |
| 1,3,5-(triaza)-2,6-(dioxa)-naphthalene | Other |
| 2 (amino)purine | Other |
| 2,4,5-(trimethyl)phenyl | Other |
| 2' methyl, 2'amino, 2'azido, 2'fluoro-cytidine | Other |
| 2' methyl, 2'amino, 2'azido, 2'fluoro-adenine | Other |
| 2'methyl, 2'amino, 2'azido, 2'fluoro-uridine | Other |
| 2'-amino-2'-deoxyribose | Other |
| 2-amino-6-Chloro-purine | Other |
| 2-aza-inosinyl | Other |
| 2'-azido-2'-deoxyribose | Other |
| 2'fluoro-2'-deoxyribose | Other |
| 2'-fluoro-modified bases | Other |
| 2'-O-methyl-ribose | Other |
| 2-oxo-7-aminopyridopyrimidin-3-yl | Other |
| 2-oxo-pyridopyrimidine-3-yl | Other |
| 2-pyridinone | Other |
| 3 nitropyrrole | Other |
| 3-(methyl)-7-(propynyl)isocarbostyrilyl | Other |
| 3-(methyl)isocarbostyrilyl | Other |
| 4-(fluoro)-6-(methyl)benzimidazole | Other |
| 4-(methyl)benzimidazole | Other |
| 4-(methyl)indolyl | Other |
| 4,6-(dimethyl)indolyl | Other |
| 5 nitroindole | Other |
| 5 substituted pyrimidines | Other |
| 5-(methyl)isocarbostyrilyl | Other |
| 5-nitroindole | Other |
| 6-(aza)pyrimidine | Other |
| 6-(azo)thymine | Other |
| 6-(methyl)-7-(aza)indolyl | Other |
| 6-chloro-purine | Other |
| 6-phenyl-pyrrolo-pyrimidin-2-on-3-yl | Other |
| 7-(aminoalkylhydroxy)-1-(aza)-2-(thio)-3-(aza)-phenthiazin-1-yl | Other |
| 7-(aminoalkylhydroxy)-1-(aza)-2-(thio)-3-(aza)-phenoxazin-1-yl | Other |
| 7-(aminoalkylhydroxy)-1,3-(diaza)-2-(oxo)-phenoxazin-1-yl | Other |
| 7-(aminoalkylhydroxy)-1,3-(diaza)-2-(oxo)-phenthiazin-1-yl | Other |
| 7-(aminoalkylhydroxy)-1,3-(diaza)-2-(oxo)-phenoxazin-1-yl | Other |
| 7-(aza)indolyl | Other |
| 7-(guanidiniumalkylhydroxy)-1-(aza)-2-(thio)-3-(aza)-phenoxazinl-yl | Other |
| 7-(guanidiniumalkylhydroxy)-1-(aza)-2-(thio)-3-(aza)-phenthiazin-1-yl | Other |
| 7-(guanidiniumalkylhydroxy)-1-(aza)-2-(thio)-3-(aza)-phenoxazin-1-yl | Other |
| 7-(guanidiniumalkylhydroxy)-1,3-(diaza)-2-(oxo)-phenoxazin-1-yl | Other |
| 7-(guanidiniumalkyl-hydroxy)-1,3-(diaza)-2-(oxo)-phenthiazin-1-yl | Other |
| 7-(guanidiniumalkylhydroxy)-1,3-(diaza)-2-(oxo)-phenoxazin-1-yl | Other |
| 7-(propynyl)isocarbostyrilyl | Other |
| 7-(propynyl)isocarbostyrilyl, propynyl-7-(aza)indolyl | Other |
| 7-deaza-inosinyl | Other |
| 7-substituted 1-(aza)-2-(thio)-3-(aza)-phenoxazin-1-yl | Other |
| 7-substituted 1,3-(diaza)-2-(oxo)-phenoxazin-1-yl | Other |
| 9-(methyl)-imidizopyridinyl | Other |
| Aminoindolyl | Other |
| Anthracenyl | Other |
| bis-ortho-(aminoalkylhydroxy)-6-phenyl-pyrrolo-pyrimidin-2-on-3-yl | Other |
| bis-ortho-substituted-6-phenyl-pyrrolo-pyrimidin-2-on-3-yl | Other |
| Difluorotolyl | Other |
| Hypoxanthine | Other |
| Imidizopyridinyl | Other |
| Inosinyl | Other |
| Isocarbostyrilyl | Other |
| Isoguanisine | Other |
| N2-substituted purines | Other |
| N6-methyl-2-amino-purine | Other |
| N6-substituted purines | Other |
| N-alkylated derivative | Other |
| Napthalenyl | Other |
| Nitrobenzimidazolyl | Other |
| Nitroimidazolyl | Other |

TABLE 23-continued

Additional Modification types

| Name | Type |
|---|---|
| Nitroindazolyl | Other |
| Nitropyrazolyl | Other |
| Nubularine | Other |
| O6-substituted purines | Other |
| O-alkylated derivative | Other |
| ortho-(aminoalkylhydroxy)-6-phenyl-pyrrolo-pyrimidin-2-on-3-yl | Other |
| ortho-substituted-6-phenyl-pyrrolo-pyrimidin-2-on-3-yl | Other |
| Oxoformycin TP | Other |
| para-(aminoalkylhydroxy)-6-phenyl-pyrrolo-pyrimidin-2-on-3-yl | Other |
| para-substituted-6-phenyl-pyrrolo-pyrimidin-2-on-3-yl | Other |
| Pentacenyl | Other |
| Phenanthracenyl | Other |
| Phenyl | Other |
| propynyl-7-(aza)indolyl | Other |
| Pyrenyl | Other |
| pyridopyrimidin-3-yl | Other |
| pyridopyrimidin-3-yl, 2-oxo-7-amino-pyridopyrimidin-3-yl | Other |
| pyrrolo-pyrimidin-2-on-3-yl | Other |
| Pyrrolopyrimidinyl | Other |
| Pyrrolopyrizinyl | Other |
| Stilbenzyl | Other |
| substituted 1,2,4-triazoles | Other |
| Tetracenyl | Other |
| Tubercidine | Other |
| Xanthine | Other |
| Xanthosine-5'-TP | Other |
| 2-thio-zebularine | Other |
| 5-aza-2-thio-zebularine | Other |
| 7-deaza-2-amino-purine | Other |
| pyridin-4-one ribonucleoside | Other |
| 2-Amino-riboside-TP | Other |
| Formycin A TP | Other |
| Formycin B TP | Other |
| Pyrrolosine TP | Other |
| 2'-OH-ara-adenosine TP | Other |
| 2'-OH-ara-cytidine TP | Other |
| 2'-OH-ara-uridine TP | Other |
| 2'-OH-ara-guanosine TP | Other |
| 5-(2-carbomethoxyvinyl)uridine TP | Other |
| N6-(19-Amino-pentaoxanonadecyl)adenosine TP | Other |

The polynucleotides of the NAVs can include any useful linker between the nucleosides. Such linkers, including backbone modifications are given in Table 24.

TABLE 24

Linker modifications

| Name | TYPE |
|---|---|
| 3'-alkylene phosphonates | Linker |
| 3'-amino phosphoramidate | Linker |
| alkene containing backbones | Linker |
| Aminoalkylphosphoramidates | Linker |
| Aminoalkylphosphotriesters | Linker |
| Boranophosphates | Linker |
| —CH2—O—N(CH3)—CH2— | Linker |
| —CH2—N(CH3)—N(CH3)—CH2— | Linker |
| —CH2—NH—CH2— | Linker |
| chiral phosphonates | Linker |
| chiral phosphorothioates | Linker |
| formacetyl and thioformacetyl backbones | Linker |
| methylene (methylimino) | Linker |
| methylene formacetyl and thioformacetyl backbones | Linker |
| methyleneimino and methylenehydrazino backbones | Linker |
| morpholino linkages | Linker |
| —N(CH3)—CH2—CH2— | Linker |
| oligonucleosides with heteroatom internucleoside linkage | Linker |
| Phosphinates | Linker |
| phosphoramidates | Linker |
| Phosphorodithioates | Linker |
| phosphorothioate internucleoside linkages | Linker |
| Phosphorothioates | Linker |

TABLE 24-continued

Linker modifications

| Name | TYPE |
|---|---|
| Phosphotriesters | Linker |
| PNA | Linker |
| siloxane backbones | Linker |
| sulfamate backbones | Linker |
| sulfide sulfoxide and sulfone backbones | Linker |
| sulfonate and sulfonamide backbones | Linker |
| Thionoalkylphosphonates | Linker |
| Thionoalkylphosphotriesters | Linker |
| Thionophosphoramidates | Linker |

The polynucleotides of the NAVs of the invention can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

Non-natural modified nucleotides may be introduced to polynucleotides, e.g., of the NAVs of the invention, or nucleic acids during synthesis or post-synthesis of the chains to achieve desired functions or properties. The modifications may be on internucleotide lineage, the purine or pyrimidine bases, or sugar. The modification may be introduced at the terminal of a chain or anywhere else in the chain; with chemical synthesis or with a polymerase enzyme. For example, hexitol nucleic acids (HNAs) are nuclease resistant and provide strong hybridization to RNA. Short messenger RNAs (mRNAs) with hexitol residues in two codons have been constructed (Lavrik et al., *Biochemistry*, 40, 11777-11784 (2001), the contents of which are incorporated herein by reference in their entirety). The antisense effects of a chimeric HNA gapmer oligonucleotide comprising a phosphorothioate central sequence flanked by 5' and 3' HNA sequences have also been studied (See e.g., Kang et al., *Nucleic Acids Research*, vol. 32(4), 4411-4419 (2004), the contents of which are incorporated herein by reference in their entirety). The preparation and uses of modified nucleotides comprising 6-member rings in RNA interference, antisense therapy or other applications are disclosed in US Pat. Application No. 2008/0261905, US Pat. Application No. 2010/0009865, and PCT Application No. WO97/30064 to Herdewijn et al.; the contents of each of which are herein incorporated by reference in their entireties). Modified nucleic acids and their synthesis are disclosed in copending PCT applications No. PCT/US2012/058519, the contents of which are incorporated herein by reference for their entirety. The synthesis and strategy of modified polynucleotides is reviewed by Verma and Eckstein in *Annual Review of Biochemistry*, vol. 76, 99-134 (1998), the contents of which are incorporated herein by reference in their entirety.

Either enzymatic or chemical ligation methods can be used to conjugate polynucleotides or their regions with different functional blocks, such as fluorescent labels, liquids, nanoparticles, delivery agents, etc. The conjugates of polynucleotides and modified polynucleotides are reviewed by Goodchild in *Bioconjugate Chemistry*, vol. 1(3), 165-187 (1990), the contents of which are incorporated herein by reference in their entirety. U.S. Pat. No. 6,835,827 and U.S. Pat. No. 6,525,183 to Vinayak et al. (the contents of each of which are herein incorporated by reference in their entireties) teach synthesis of labeled oligonucleotides using a labeled solid support.

In certain embodiments, it may desirable to intracellularly degrade a polynucleotide introduced into the cell. For example, degradation of a polynucleotide may be preferable if precise timing of protein production is desired. Thus, in some embodiments, the invention provides a polynucleotide containing a degradation domain, which is capable of being acted on in a directed manner within a cell.

Any of the regions of the polynucleotides may be chemically modified as taught herein or as taught in International Application Number PCT/2012/058519 filed Oct. 3, 2012 and U.S. Provisional Application No. 61/837,297 filed Jun. 20, 2013 the contents of each of which are incorporated herein by reference in its entirety.

Modified Polynucleotide Molecules

The present invention also includes building blocks, e.g., modified ribonucleosides, and modified ribonucleotides, of polynucleotide molecules, e.g., of the NAVs of the invention. For example, these building blocks can be useful for preparing the polynucleotides of the invention. Such building blocks are taught in International Application Number PCT/2012/058519 filed Oct. 3, 2012 and U.S. Provisional Application No. 61/837,297 filed Jun. 20, 2013 the contents of each of which are incorporated herein by reference in its entirety.

Modifications on the Sugar

The modified nucleosides and nucleotides (e.g., building block molecules), which may be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), —O(CH$_2$CH$_2$O)$_n$CH$_2$CH$_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Application Number PCT/2012/058519 filed Oct. 3, 2012 and U.S. Provisional Application No. 61/837,297 filed Jun. 20, 2013 the contents of each of which are incorporated herein by reference in its entirety.

Modifications on the Nucleobase

The present disclosure provides for modified nucleosides and nucleotides. As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group. The modified nucleotides may by synthesized by any useful method, as described herein (e.g., chemically, enzymatically, or recombinantly to include one or more modified or non-natural nucleosides). The polynucleotides may comprise a region or regions of linked nucleosides. Such regions may have variable backbone linkages. The linkages may be standard phosphoester linkages, in which case the polynucleotides would comprise regions of nucleotides.

The modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil.

The modified nucleosides and nucleotides can include a modified nucleobase. Examples of nucleobases found in RNA include, but are not limited to, adenine, guanine, cytosine, and uracil. Examples of nucleobase found in DNA include, but are not limited to, adenine, guanine, cytosine, and thymine. Such modified nucleobases (including the distinctions between naturally occurring and non-naturally occurring) are taught in International Application Number PCT/2012/058519 filed Oct. 3, 2012 and U.S. Provisional Application No. 61/837,297 filed Jun. 20, 2013 the contents of each of which are incorporated herein by reference in its entirety.

Combinations of Modified Sugars, Nucleobases, and Internucleoside Linkages

The polynucleotides of the invention, e.g., the NAVs of the invention, can include a combination of modifications to the sugar, the nucleobase, and/or the internucleoside linkage. These combinations can include any one or more modifications described herein.

Examples of modified nucleotides and modified nucleotide combinations are provided below in Table 25. These combinations of modified nucleotides can be used to form the polynucleotides of the invention. Unless otherwise noted, the modified nucleotides may be completely substituted for the natural nucleotides of the polynucleotides of the invention. As a non-limiting example, the natural nucleotide uridine may be substituted with a modified nucleoside described herein. In another non-limiting example, the natural nucleotide uridine may be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker may be incorporated into the polynucleotides of the invention and such modifications are taught in International Application Number PCT/2012/058519 filed Oct. 3, 2012 and U.S. Provisional Application No. 61/837,297 filed Jun. 20, 2013 the contents of each of which are incorporated herein by reference in its entirety.

TABLE 25

Combinations

| Modified Nucleotide | Modified Nucleotide Combination |
| --- | --- |
| α-thio-cytidine | α-thio-cytidine/5-iodo-uridine |
| | α-thio-cytidine/N1-methyl-pseudouridine |
| | α-thio-cytidine/α-thio-uridine |
| | α-thio-cytidine/5-methyl-uridine |
| | α-thio-cytidine/pseudo-uridine |
| | about 50% of the cytosines are α-thio-cytidine |
| Pseudoisocytidine | pseudoisocytidine/5-iodo-uridine |
| | pseudoisocytidine/N1-methyl-pseudouridine |
| | pseudoisocytidine/α-thio-uridine |
| | pseudoisocytidine/5-methyl-uridine |
| | pseudoisocytidine/pseudouridine |
| | about 25% of cytosines are pseudoisocytidine |
| | pseudoisocytidine/about 50% of uridines are N1-methyl-pseudouridine and about 50% of uridines are pseudouridine |
| | pseudoisocytidine/about 25% of uridines are N1-methyl-pseudouridine and about 25% of uridines are pseudouridine |
| pyrrolo-cytidine | pyrrolo-cytidine/5-iodo-uridine |
| | pyrrolo-cytidine/N1-methyl-pseudouridine |
| | pyrrolo-cytidine/α-thio-uridine |
| | pyrrolo-cytidine/5-methyl-uridine |
| | pyrrolo-cytidine/pseudouridine |
| | about 50% of the cytosines are pyrrolo-cytidine |
| 5-methyl-cytidine | 5-methyl-cytidine/5-iodo-uridine |
| | 5-methyl-cytidine/N1-methyl-pseudouridine |
| | 5-methyl-cytidine/α-thio-uridine |
| | 5-methyl-cytidine/5-methyl-uridine |
| | 5-methyl-cytidine/pseudouridine |
| | about 25% of cytosines are 5-methyl-cytidine |
| | about 50% of cytosines are 5-methyl-cytidine |
| | 5-methyl-cytidine/5-methoxy-uridine |
| | 5-methyl-cytidine/5-bromo-uridine |
| | 5-methyl-cytidine/2-thio-uridine |
| | 5-methyl-cytidine/about 50% of uridines are 2-thio-uridine |
| | about 50% of uridines are 5-methyl-cytidine/about 50% of uridines are 2-thio-uridine |
| N4-acetyl-cytidine | N4-acetyl-cytidine/5-iodo-uridine |
| | N4-acetyl-cytidine/N1-methyl-pseudouridine |
| | N4-acetyl-cytidine/α-thio-uridine |
| | N4-acetyl-cytidine/5-methyl-uridine |
| | N4-acetyl-cytidine/pseudouridine |
| | about 50% of cytosines are N4-acetyl-cytidine |
| | about 25% of cytosines are N4-acetyl-cytidine |
| | N4-acetyl-cytidine/5-methoxy-uridine |

TABLE 25-continued

Combinations

| Modified Nucleotide | Modified Nucleotide Combination |
| --- | --- |
| | N4-acetyl-cytidine/5-bromo-uridine |
| | N4-acetyl-cytidine/2-thio-uridine |
| | about 50% of cytosines are N4-acetyl-cytidine/about 50% of uridines are 2-thio-uridine |

V. Pharmaceutical Vaccine Compositions

Formulation, Administration, Delivery and Dosing

The present invention provides pharmaceutical compositions including NAVs and NAV compositions and/or complexes optionally in combination with one or more pharmaceutically acceptable excipients.

The present inventors have discovered that NAVs are superior to current vaccines in several ways. First, subcutaneous and/or intradermal injection is better than intramuscular administration as a route of delivery. Second, the lipid nanoparticle delivery is superior to other formulations including the protamine approach in the literature by a factor of between 10-100 fold and no additional adjuvants were found to be necessary. Third modified and formulated NAVs were superior to unmodified formulated NAVs by a factor of 50 fold.

The present invention provides NAVs and NAV pharmaceutical compositions and complexes optionally in combination with one or more pharmaceutically acceptable excipients. Pharmaceutical compositions may optionally comprise one or more additional active substances, e.g. therapeutically and/or prophylactically active substances. Pharmaceutical compositions of the present invention may be sterile and/or pyrogen-free. General considerations in the formulation and/or manufacture of pharmaceutical agents may be found, for example, in *Remington: The Science and Practice of Pharmacy* 21$^{st}$ ed., Lippincott Williams & Wilkins, 2005 (incorporated herein by reference in its entirety).

In some embodiments, compositions are administered to humans, human patients or subjects. For the purposes of the present disclosure, the phrase "active ingredient" generally refers to the NAVs or the polynucleotides contained therein, e.g., antigen-encoding polynucleotides, for example, RNA polynucleotides, to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Formulations

The NAVs of the invention can be formulated using one or more excipients to: (1) increase stability; (2) increase cell transfection; (3) permit the sustained or delayed release (e.g., from a depot formulation); (4) alter the biodistribution (e.g., target to specific tissues or cell types); (5) increase the translation of encoded protein in vivo; and/or (6) alter the release profile of encoded protein (antigen) in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with NAVs (e.g., for transplantation into a subject), hyaluronidase, nanoparticle mimics and combinations thereof.

Accordingly, the formulations of the invention can include one or more excipients, each in an amount that may increases the stability of the NAV, increases cell transfection by the NAV, increases the expression of polynucleotides encoded protein, and/or alters the release profile of polynucleotide encoded proteins. Further, the polynucleotides of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the formulations described herein may contain at least one polynucleotide, e.g., antigen-encoding polynucleotide. As a non-limiting example, the formulations may contain 1, 2, 3, 4 or 5 polynucleotides.

In one embodiment, the formulations described herein may comprise more than one type of polynucleotide, e.g., antigen-encoding polynucleotide. In one embodiment, the formulation may comprise a chimeric polynucleotide in linear and circular form. In another embodiment, the formulation may comprise a circular polynucleotide and an IVT polynucleotide. In yet another embodiment, the formulation may comprise an IVT polynucleotide, a chimeric polynucleotide and a circular polynucleotide.

In one embodiment the formulation may contain polynucleotide encoding proteins selected from categories such as, but not limited to, human proteins, veterinary proteins, bacterial proteins, biological proteins, antibodies, immunogenic proteins, therapeutic peptides and proteins, secreted proteins, plasma membrane proteins, cytoplasmic and cytoskeletal proteins, intracellular membrane bound proteins, nuclear proteins, proteins associated with human disease and/or proteins associated with non-human diseases. In one embodiment, the formulation contains at least three polynucleotides encoding proteins. In one embodiment, the formulation contains at least five polynucleotide encoding proteins.

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention.

Lipidoids

The synthesis of lipidoids has been extensively described and formulations containing these compounds are particularly suited for delivery of polynucleotides (see Mahon et al., Bioconjug Chem. 2010 21:1448-1454; Schroeder et al., J Intern Med. 2010 267:9-21; Akinc et al., Nat Biotechnol.

2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), the present disclosure describes their formulation and use in delivering NAVs or polynucleotides contained therein.

Complexes, micelles, liposomes or particles can be prepared containing these lipidoids and therefore, can result in an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); herein incorporated by reference in its entirety), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-670; both of which are herein incorporated by reference in their entirety. The lipidoid formulations can include particles comprising either 3 or 4 or more components in addition to polynucleotides. As an example, formulations with certain lipidoids, include, but are not limited to, 98N12-5 and may contain 42% lipidoid, 48% cholesterol and 10% PEG (C14 alkyl chain length). As another example, formulations with certain lipidoids, include, but are not limited to, C12-200 and may contain 50% lipidoid, 10% disteroylphosphatidyl choline, 38.5% cholesterol, and 1.5% PEG-DMG.

In one embodiment, a polynucleotide formulated with a lipidoid for systemic intravenous administration can target the liver. For example, a final optimized intravenous formulation using polynucleotides, and comprising a lipid molar composition of 42% 98N12-5, 48% cholesterol, and 10% PEG-lipid with a final weight ratio of about 7.5 to 1 total lipid to polynucleotides, and a C14 alkyl chain length on the PEG lipid, with a mean particle size of roughly 50-60 nm, can result in the distribution of the formulation to be greater than 90% to the liver. (see, Akinc et al., Mol Ther. 2009 17:872-879; herein incorporated by reference in its entirety).

In another example, an intravenous formulation using a C12-200 (see U.S. provisional application 61/175,770 and published international application WO2010129709, each of which is herein incorporated by reference in their entirety) lipidoid may have a molar ratio of 50/10/38.5/1.5 of C12-200/disteroylphosphatidyl choline/cholesterol/PEG-DMG, with a weight ratio of 7 to 1 total lipid to polynucleotides, and a mean particle size of 80 nm may be effective to deliver polynucleotides to hepatocytes (see, Love et al., Proc Natl Acad Sci USA. 2010 107:1864-1869 herein incorporated by reference in its entirety). In another embodiment, an MD1 lipidoid-containing formulation may be used to effectively deliver polynucleotides to hepatocytes in vivo.

The characteristics of optimized lipidoid formulations for intramuscular or subcutaneous routes may vary significantly depending on the target cell type and the ability of formulations to diffuse through the extracellular matrix into the blood stream. While a particle size of less than 150 nm may be desired for effective hepatocyte delivery due to the size of the endothelial fenestrae (see, Akinc et al., Mol Ther. 2009 17:872-879 herein incorporated by reference in its entirety), use of a lipidoid-formulated NAVs to deliver the formulation to other cells types including, but not limited to, endothelial cells, myeloid cells, and muscle cells may not be similarly size-limited.

Use of lipidoid formulations to deliver siRNA in vivo to other non-hepatocyte cells such as myeloid cells and endothelium has been reported (see Akinc et al., Nat Biotechnol. 2008 26:561-569; Leuschner et al., Nat Biotechnol. 2011 29:1005-1010; Cho et al. Adv. Funct. Mater. 2009 19:3112-3118; $8^{th}$ International Judah Folkman Conference, Cambridge, Mass. Oct. 8-9, 2010; each of which is herein incorporated by reference in its entirety). Effective delivery to myeloid cells, such as monocytes, lipidoid formulations may have a similar component molar ratio. Different ratios of lipidoids and other components including, but not limited to, disteroylphosphatidyl choline, cholesterol and PEG-DMG, may be used to optimize the formulation of the RNAVs for delivery to different cell types including, but not limited to, hepatocytes, myeloid cells, muscle cells, etc. For example, the component molar ratio may include, but is not limited to, 50% C12-200, 10% disteroylphosphatidyl choline, 38.5% cholesterol, and %1.5 PEG-DMG (see Leuschner et al., Nat Biotechnol 2011 29:1005-1010; herein incorporated by reference in its entirety). The use of lipidoid formulations for the localized delivery of nucleic acids to cells (such as, but not limited to, adipose cells and muscle cells) via either subcutaneous or intramuscular delivery, may not require all of the formulation components desired for systemic delivery, and as such may comprise only the lipidoid and the NAV.

Combinations of different lipidoids may be used to improve the efficacy of polynucleotides directed protein production as the lipidoids may be able to increase cell transfection by the RNAV; and/or increase the translation of encoded protein (see Whitehead et al., Mol. Ther. 2011, 19:1688-1694, herein incorporated by reference in its entirety).

Liposomes, Lipoplexes, and Lipid Nanoparticles

The NAVs of the invention can be formulated using one or more liposomes, lipoplexes, or lipid nanoparticles. In one embodiment, pharmaceutical compositions of NAVs include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles *Hum Gene Ther.* 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In a preferred embodiment, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In one embodiment, pharmaceutical compositions may include liposomes which may be formed to deliver polynucleotides which may encode at least one immunogen (antigen) or any other polypeptide of interest. The NAV may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In another embodiment, liposomes may be formulated for targeted delivery. As a non-limiting example, the liposome may be formulated for targeted delivery to the liver. The liposome used for targeted delivery may include, but is not limited to, the liposomes described in and methods of making liposomes described in US Patent Publication No. US20130195967, the contents of which are herein incorporated by reference in its entirety.

In another embodiment, the polynucleotide which may encode an immunogen (antigen) may be formulated in a cationic oil-in-water emulsion where the emulsion particle comprises an oil core and a cationic lipid which can interact with the polynucleotide anchoring the molecule to the emulsion particle (see International Pub. No. WO2012006380; herein incorporated by reference in its entirety).

In one embodiment, the NAVs may be formulated in a water-in-oil emulsion comprising a continuous hydrophobic phase in which the hydrophilic phase is dispersed. As a non-limiting example, the emulsion may be made by the methods described in International Publication No. WO201087791, the contents of which are herein incorporated by reference in its entirety.

In another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; the contents of each of which is herein incorporated by reference in their entirety). In another embodiment, the polynucleotides encoding an immunogen may be formulated in a lipid vesicle which may have crosslinks between functionalized lipid bilayers (see U.S. Pub. No. 20120177724, the contents of which is herein incorporated by reference in its entirety).

In one embodiment, the polynucleotides may be formulated in a liposome as described in International Patent Publication No. WO2013086526, the contents of which is herein incorporated by reference in its entirety. The NAVs may be encapsulated in a liposome using reverse pH gradients and/or optimized internal buffer compositions as described in International Patent Publication No. WO2013086526, the contents of which is herein incorporated by reference in its entirety.

In one embodiment, the NAV pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the cationic lipid may be a low molecular weight cationic lipid such as those described in US Patent Application No. 20130090372, the contents of which are herein incorporated by reference in its entirety.

In one embodiment, the NAVs may be formulated in a lipid vesicle which may have crosslinks between functionalized lipid bilayers.

In one embodiment, the NAVs may be formulated in a liposome comprising a cationic lipid. The liposome may have a molar ratio of nitrogen atoms in the cationic lipid to the phosphates in the RNA (N:P ratio) of between 1:1 and 20:1 as described in International Publication No. WO2013006825, herein incorporated by reference in its entirety. In another embodiment, the liposome may have a N:P ratio of greater than 20:1 or less than 1:1.

In one embodiment, the NAVs may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine and the cationic peptides described in International Pub. No. WO2012013326 or US Patent Pub. No. US20130142818; each of which is herein incorporated by reference in its entirety. In another embodiment, the NAVs may be formulated in a lipid-polycation complex which may further include a non-cationic lipid such as, but not limited to, cholesterol or dioleoyl phosphatidylethanolamine (DOPE).

In one embodiment, the NAVs may be formulated in an aminoalcohol lipidoid. Aminoalcohol lipidoids which may be used in the present invention may be prepared by the methods described in U.S. Pat. No. 8,450,298, herein incorporated by reference in its entirety.

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety). In some embodiments, liposome formulations may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes may be from about 5:1 to about 20:1, from about 10:1 to about 25:1, from about 15:1 to about 30:1 and/or at least 30:1.

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[ω-methoxy-poly(ethyleneglycol)2000)carbamoyl)]-1,2-dimyristyloxypropyl-3-amine) (also referred to herein as PEG-DOMG) as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the NAVs may be formulated in a lipid nanoparticle such as those described in International Publication No. WO2012170930, the contents of which is herein incorporated by reference in its entirety.

In one embodiment, the NAV formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in US Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

Lipid nanoparticle formulations typically comprise a lipid, in particular, an ionizable cationic lipid, for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), or di((Z)-non-2-en-1-yl) 9-((4-(dimethylamino)butanoyl)oxy)heptadecanedioate (L319), and further comprise a neutral lipid, a sterol and a molecule capable of reducing particle aggregation, for example a PEG or PEG-modified lipid.

In one embodiment, the lipid nanoparticle formulation consists essentially of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of about 20-60% cationic lipid:5-25% neutral lipid:25-55% sterol; 0.5-15% PEG-lipid.

In one embodiment, the formulation includes from about 25% to about 75% on a molar basis of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), e.g., from about 35 to about 65%, from about 45 to about 65%, about 60%, about 57.5%, about 50% or about 40% on a molar basis.

In one embodiment, the formulation includes from about 0.5% to about 15% on a molar basis of the neutral lipid e.g., from about 3 to about 12%, from about 5 to about 10% or about 15%, about 10%, or about 7.5% on a molar basis. Exemplary neutral lipids include, but are not limited to, DSPC, POPC, DPPC, DOPE and SM. In one embodiment, the formulation includes from about 5% to about 50% on a molar basis of the sterol (e.g., about 15 to about 45%, about 20 to about 40%, about 40%, about 38.5%, about 35%, or about 31% on a molar basis. An exemplary sterol is cholesterol. In one embodiment, the formulation includes from about 0.5% to about 20% on a molar basis of the PEG or PEG-modified lipid (e.g., about 0.5 to about 10%, about 0.5 to about 5%, about 1.5%, about 0.5%, about 1.5%, about 3.5%, or about 5% on a molar basis. In one embodiment, the PEG or PEG modified lipid comprises a PEG molecule of an average molecular weight of 2,000 Da. In other embodiments, the PEG or PEG modified lipid comprises a PEG molecule of an average molecular weight of less than 2,000, for example around 1,500 Da, around 1,000 Da, or around 500 Da. Exemplary PEG-modified lipids include, but are not limited to, PEG-distearoyl glycerol (PEG-DMG) (also referred herein as PEG-C14 or C14-PEG), PEG-cDMA (further discussed in Reyes et al. *J. Controlled Release*, 107, 276-287 (2005) the contents of which are herein incorporated by reference in its entirety)

In one embodiment, the formulations of the inventions include 25-75% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 0.5-15% of the neutral lipid, 5-50% of the sterol, and 0.5-20% of the PEG or PEG-modified lipid on a molar basis.

In one embodiment, the formulations of the inventions include 35-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 3-12% of the neutral lipid, 15-45% of the sterol, and 0.5-10% of the PEG or PEG-modified lipid on a molar basis.

In one embodiment, the formulations of the inventions include 45-65% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), 5-10% of the neutral lipid, 25-40% of the sterol, and 0.5-10% of the PEG or PEG-modified lipid on a molar basis.

In one embodiment, the formulations of the inventions include about 60% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.5% of the neutral lipid, about 31% of the sterol, and about 1.5% of the PEG or PEG-modified lipid on a molar basis.

In one embodiment, the formulations of the inventions include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 38.5% of the sterol, and about 1.5% of the PEG or PEG-modified lipid on a molar basis.

In one embodiment, the formulations of the inventions include about 50% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 10% of the neutral lipid, about 35% of the sterol, about 4.5% or about 5% of the PEG or PEG-modified lipid, and about 0.5% of the targeting lipid on a molar basis.

In one embodiment, the formulations of the inventions include about 40% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 15% of the neutral lipid, about 40% of the sterol, and about 5% of the PEG or PEG-modified lipid on a molar basis.

In one embodiment, the formulations of the inventions include about 57.2% of a cationic lipid selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319), about 7.1% of the neutral lipid, about 34.3% of the sterol, and about 1.4% of the PEG or PEG-modified lipid on a molar basis.

In one embodiment, the formulations of the inventions include about 57.5% of a cationic lipid selected from the PEG lipid is PEG-cDMA (PEG-cDMA is further discussed in Reyes et al. (*J. Controlled Release*, 107, 276-287 (2005), the contents of which are herein incorporated by reference in its entirety), about 7.5% of the neutral lipid, about 31.5% of the sterol, and about 3.5% of the PEG or PEG-modified lipid on a molar basis.

In preferred embodiments, lipid nanoparticle formulation consists essentially of a lipid mixture in molar ratios of about 20-70% cationic lipid: 5-45% neutral lipid: 20-55% cholesterol: 0.5-15% PEG-modified lipid; more preferably in a molar ratio of about 20-60% cationic lipid:5-25% neutral lipid:25-55% cholesterol:0.5-15% PEG-modified lipid.

In particular embodiments, the molar lipid ratio is approximately 50/10/38.5/1.5 (mol % cationic lipid/neutral lipid, e.g., DSPC/Chol/PEG-modified lipid, e.g., PEG-DMG, PEG-DSG or PEG-DPG), 57.2/7.1134.3/1.4 (mol % cationic lipid/neutral lipid, e.g., DPPC/Chol/PEG-modified lipid, e.g., PEG-cDMA), 40/15/40/5 (mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10

(mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

Exemplary lipid nanoparticle compositions and methods of making same are described, for example, in Semple et al. (2010) *Nat. Biotechnol.* 28:172-176; Jayarama et al. (2012), *Angew. Chem. Int. Ed.,* 51: 8529-8533; and Maier et al. (2013) *Molecular Therapy* 21, 1570-1578 (the contents of each of which are incorporated herein by reference in their entirety).

In one embodiment, the lipid nanoparticle formulations described herein may comprise a cationic lipid, a PEG lipid and a structural lipid and optionally comprise a non-cationic lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In one embodiment, the cationic lipid may be any cationic lipid described herein such as, but not limited to, DLin-KC2-DMA, DLin-MC3-DMA and L319.

In one embodiment, the lipid nanoparticle formulations described herein may be 4 component lipid nanoparticles. The lipid nanoparticle may comprise a cationic lipid, a non-cationic lipid, a PEG lipid and a structural lipid. As a non-limiting example, the lipid nanoparticle may comprise about 40-60% of cationic lipid, about 5-15% of a non-cationic lipid, about 1-2% of a PEG lipid and about 30-50% of a structural lipid. As another non-limiting example, the lipid nanoparticle may comprise about 50% cationic lipid, about 10% non-cationic lipid, about 1.5% PEG lipid and about 38.5% structural lipid. As yet another non-limiting example, the lipid nanoparticle may comprise about 55% cationic lipid, about 10% non-cationic lipid, about 2.5% PEG lipid and about 32.5% structural lipid. In one embodiment, the cationic lipid may be any cationic lipid described herein such as, but not limited to, DLin-KC2-DMA, DLin-MC3-DMA and L319.

In one embodiment, the lipid nanoparticle formulations described herein may comprise a cationic lipid, a non-cationic lipid, a PEG lipid and a structural lipid. As a non-limiting example, the lipid nanoparticle comprise about 50% of the cationic lipid DLin-KC2-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DOMG and about 38.5% of the structural lipid cholesterol. As a non-limiting example, the lipid nanoparticle comprise about 50% of the cationic lipid DLin-MC3-DMA, about 10% of the non-cationic lipid DSPC, about 1.5% of the PEG lipid PEG-DMG and about 38.5% of the structural lipid cholesterol. As yet another non-limiting example, the lipid nanoparticle comprise about 55% of the cationic lipid L319, about 10% of the non-cationic lipid DSPC, about 2.5% of the PEG lipid PEG-DMG and about 32.5% of the structural lipid cholesterol.

In one embodiment, the cationic lipid may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and US20130225836; the contents of each of which are herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365, WO2012044638 and WO2013116126 or US Patent Publication No. US20130178541 and US20130225836; the contents of each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXII of U.S. Pat. No. 7,404,969 and formula I-VI of US Patent Publication No. US20100036115, formula I of US Patent Publication No US20130123338; each of which is herein incorporated by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16, 19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctaco sa-19,22-dien-9-amine, (18Z,21Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21 Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11, 14-dien-1-yl]pyrrolidine, (20Z)—N,N-dimethylheptacos-20-en-10-amine, (15Z)—N,N-dimethyleptacos-15-en-10-amine, (14Z)—N,N-dimethylnonacos-14-en-10-amine, (17Z)—N,N-dimethylnonacos-17-en-10-amine, (24Z)—N, N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-1-[(1S,2R)-2-octylcyclopropyl]henicosan-10-amine, N,N-dimethyl-1-[(1S,2S)-2-{[(1R,2R)-2-pentylcyclopropyl]methyl}cyclopropyl]nonadecan-10-amine, N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]

heptyl}dodecan-1-amine, 1-R1R,2S)-2-heptylcyclopropyl]-N,N-dimethyloctadecan-9-amine, 1-[(R1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(R9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxyl-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid may be a cleavable lipid such as those described in International Publication No. WO2012170889, herein incorporated by reference in its entirety.

In another embodiment, the lipid may be a cationic lipid such as, but not limited to, Formula (I) of U.S. Patent Application No. US20130064894, the contents of which are herein incorporated by reference in its entirety.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724, WO201021865, WO2013086373 and WO2013086354; the contents of each of which are herein incorporated by reference in their entirety.

In another embodiment, the cationic lipid may be a trialkyl cationic lipid. Non-limiting examples of trialkyl cationic lipids and methods of making and using the trialkyl cationic lipids are described in International Patent Publication No. WO2013126803, the contents of which are herein incorporated by reference in its entirety.

In one embodiment, the LNP formulations of the NAVs may contain PEG-c-DOMG at 3% lipid molar ratio. In another embodiment, the LNP formulations RNAVs may contain PEG-c-DOMG at 1.5% lipid molar ratio.

In one embodiment, the pharmaceutical compositions of the NAVs may include at least one of the PEGylated lipids described in International Publication No. WO2012099755, the contents of which is herein incorporated by reference in its entirety.

In one embodiment, the LNP formulation may contain PEG-DMG 2000 (1,2-dimyristoyl-sn-glycero-3-phophoethanolamine-N-[methoxy(polyethylene glycol)-2000). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA vaccines, PNAS 2012; PMID: 22908294; herein incorporated by reference in its entirety).

In one embodiment, the LNP formulation may be formulated by the methods described in International Publication Nos. WO2011127255 or WO2008103276, the contents of each of which is herein incorporated by reference in their entirety. As a non-limiting example, the NAVs described herein may be encapsulated in LNP formulations as described in WO2011127255 and/or WO2008103276; each of which are herein incorporated by reference in their entirety.

In one embodiment, the NAVs described herein may be formulated in a nanoparticle to be delivered by a parenteral route as described in U.S. Pub. No. US20120207845; the contents of which are herein incorporated by reference in its entirety.

In one embodiment, the NAVs may be formulated in a lipid nanoparticle made by the methods described in US Patent Publication No US20130156845 or International Publication No WO2013093648 or WO2012024526, each of which is herein incorporated by reference in its entirety.

The lipid nanoparticles described herein may be made in a sterile environment by the system and/or methods described in US Patent Publication No. US20130164400, herein incorporated by reference in its entirety.

In one embodiment, the LNP formulation may be formulated in a nanoparticle such as a nucleic acid-lipid particle described in U.S. Pat. No. 8,492,359, the contents of which are herein incorporated by reference in its entirety. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle. The nucleic acid in the nanoparticle may be the polynucleotides described herein and/or are known in the art.

In one embodiment, the LNP formulation may be formulated by the methods described in International Publication Nos. WO2011127255 or WO2008103276, the contents of each of which are herein incorporated by reference in their entirety. As a non-limiting example, modified RNA described herein may be encapsulated in LNP formulations as described in WO2011127255 and/or WO2008103276; the contents of each of which are herein incorporated by reference in their entirety.

In one embodiment, LNP formulations described herein may comprise a polycationic composition. As a non-limiting example, the polycationic composition may be selected from formula 1-60 of US Patent Publication No. US20050222064; the content of which is herein incorporated by reference in its entirety. In another embodiment, the LNP formulations comprising a polycationic composition may be used for the delivery of the modified RNA described herein in vivo and/or in vitro.

In one embodiment, the LNP formulations described herein may additionally comprise a permeability enhancer molecule. Non-limiting permeability enhancer molecules are described in US Patent Publication No. US20050222064; the content of which is herein incorporated by reference in its entirety.

In one embodiment, the NAV pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the NAVs may be formulated in a lyophilized gel-phase liposomal composition as described in US Publication No. US2012060293, herein incorporated by reference in its entirety.

The nanoparticle formulations may comprise a phosphate conjugate. The phosphate conjugate may increase in vivo circulation times and/or increase the targeted delivery of the nanoparticle. Phosphate conjugates for use with the present invention may be made by the methods described in International Application No. WO2013033438 or US Patent Publication No. US20130196948, the contents of each of which are herein incorporated by reference in its entirety. As a non-limiting example, the phosphate conjugates may include a compound of any one of the formulas described in International Application No. WO2013033438, herein incorporated by reference in its entirety.

The nanoparticle formulation may comprise a polymer conjugate. The polymer conjugate may be a water soluble conjugate. The polymer conjugate may have a structure as described in U.S. Patent Application No. 20130059360, the contents of which are herein incorporated by reference in its entirety. In one aspect, polymer conjugates with the polynucleotides of the present invention may be made using the methods and/or segmented polymeric reagents described in U.S. Patent Application No. 20130072709, herein incorporated by reference in its entirety. In another aspect, the polymer conjugate may have pendant side groups comprising ring moieties such as, but not limited to, the polymer conjugates described in US Patent Publication No. US20130196948, the contents of which is herein incorporated by reference in its entirety.

The nanoparticle formulations may comprise a conjugate to enhance the delivery of nanoparticles of the present invention in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al (Science 2013 339, 971-975), herein incorporated by reference in its entirety). As shown by Rodriguez et al. the self peptides delayed macrophage-mediated clearance of nanoparticles which enhanced delivery of the nanoparticles. In another aspect, the conjugate may be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In one embodiment, the NAVs of the present invention are formulated in nanoparticles which comprise a conjugate to enhance the delivery of the nanoparticles of the present invention in a subject. The conjugate may be the CD47 membrane or the conjugate may be derived from the CD47 membrane protein, such as the "self" peptide described previously. In another aspect the nanoparticle may comprise PEG and a conjugate of CD47 or a derivative thereof. In yet another aspect, the nanoparticle may comprise both the "self" peptide described above and the membrane protein CD47.

In another aspect, a "self" peptide and/or CD47 protein may be conjugated to a virus-like particle or pseudovirion, as described herein for delivery of the NAVs of the present invention.

In another embodiment, NAV pharmaceutical compositions comprising the polynucleotides of the present invention and a conjugate which may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in US Patent Publication No. US20130184443, the contents of which are herein incorporated by reference in its entirety.

The nanoparticle formulations may be a carbohydrate nanoparticle comprising a carbohydrate carrier and a NAV. As a non-limiting example, the carbohydrate carrier may include, but is not limited to, an anhydride-modified phytoglycogen or glycogen-type material, phytoglycogen octenyl succinate, phytoglycogen beta-dextrin, anhydride-modified phytoglycogen beta-dextrin. (See e.g., International Publication No. WO2012109121; the contents of which are herein incorporated by reference in its entirety).

Nanoparticle formulations of the present invention may be coated with a surfactant or polymer in order to improve the delivery of the particle. In one embodiment, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, NAVs within the central nervous system. As a non-limiting example nanoparticles comprising a hydrophilic coating and methods of making such nanoparticles are described in US Patent Publication No. US20130183244, the contents of which are herein incorporated by reference in its entirety.

In one embodiment, the lipid nanoparticles of the present invention may be hydrophilic polymer particles. Non-limiting examples of hydrophilic polymer particles and methods of making hydrophilic polymer particles are described in US Patent Publication No. US20130210991, the contents of which are herein incorporated by reference in its entirety.

In another embodiment, the lipid nanoparticles of the present invention may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon.

In one embodiment, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a polynucleotide described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Mucus is located on mucosal tissue such as, but not limited to, oral (e.g., the buccal and esophageal membranes and tonsil tissue), ophthalmic, gastrointestinal (e.g., stomach, small intestine, large intestine, colon, rectum), nasal, respiratory (e.g., nasal, pharyngeal, tracheal and bronchial membranes), genital (e.g., vaginal, cervical and urethral membranes). Nanoparticles larger than 10-200 nm which are preferred for higher drug encapsulation efficiency and the ability to provide the sustained delivery of a wide array of drugs have been thought to be too large to rapidly diffuse through mucosal barriers. Mucus is continuously secreted, shed, discarded or digested and recycled so most of the trapped particles may be removed from the mucosla tissue within seconds or within a few hours. Large polymeric nanoparticles (200 nm-500 nm in diameter) which have been coated densely with a low molecular weight polyethylene glycol (PEG) diffused through mucus only 4 to 6-fold lower than the same particles diffusing in water (Lai et al. PNAS 2007 104(5):1482-487; Lai et al. Adv Drug Deliv Rev. 2009 61(2): 158-171; each of which is herein incorporated by reference in their entirety). The transport of nanoparticles may be determined using rates of permeation and/or fluorescent microscopy techniques including, but not limited to, fluorescence recovery after photobleaching (FRAP) and high resolution multiple particle tracking (MPT). As a non-limiting example, compositions which can penetrate a mucosal barrier may be made as described in U.S. Pat. No. 8,241,670 or International Patent Publication No. WO2013110028, the contents of each of which are herein incorporated by reference in its entirety.

The lipid nanoparticle engineered to penetrate mucus may comprise a polymeric material (i.e. a polymeric core) and/or a polymer-vitamin conjugate and/or a tri-block co-polymer. The polymeric material may include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyetheneimines, polyisocyanates, polyacrylates, polymethacrylates, polyacrylonitriles, and polyarylates. The polymeric material may be biodegradable and/or biocompatible. Non-limiting examples of biocompatible polymers are described in International Patent Publication No. WO2013116804, the contents of which are herein incorporated by reference in its entirety. The polymeric material may additionally be irradiated. As a non-limiting example, the polymeric material may be gamma irradiated (See e.g., International App. No. WO201282165, herein incorporated by reference in its entirety). Non-limiting examples of specific polymers include poly(caprolactone) (PCL), ethylene vinyl acetate polymer (EVA), poly(lactic acid) (PLA), poly(L-lactic acid) (PLLA), poly(glycolic acid) (PGA), poly (lactic acid-co-glycolic acid) (PLGA), poly(L-lactic acid-co-glycolic acid) (PLLGA), poly(D,L-lactide) (PDLA), poly (L-lactide) (PLLA), poly(D,L-lactide-co-caprolactone), poly(D,L-lactide-co-caprolactone-co-glycolide), poly(D,L-lactide-co-PEO-co-D,L-lactide), poly(D,L-lactide-co-PPO-co-D,L-lactide), polyalkyl cyanoacralate, polyurethane, poly-L-lysine (PLL), hydroxypropyl methacrylate (HPMA), polyethyleneglycol, poly-L-glutamic acid, poly(hydroxy acids), polyanhydrides, polyorthoesters, poly(ester amides), polyamides, poly(ester ethers), polycarbonates, polyalkylenes such as polyethylene and polypropylene, polyalkylene glycols such as poly(ethylene glycol) (PEG), polyalkylene oxides (PEO), polyalkylene terephthalates such as poly (ethylene terephthalate), polyvinyl alcohols (PVA), polyvinyl ethers, polyvinyl esters such as poly(vinyl acetate), polyvinyl halides such as poly(vinyl chloride) (PVC), polyvinylpyrrolidone, polysiloxanes, polystyrene (PS), polyurethanes, derivatized celluloses such as alkyl celluloses, hydroxyalkyl celluloses, cellulose ethers, cellulose esters, nitro celluloses, hydroxypropylcellulose, carboxymethylcellulose, polymers of acrylic acids, such as poly(methyl(meth) acrylate) (PMMA), poly(ethyl(meth)acrylate), poly(butyl (meth)acrylate), poly(isobutyl(meth)acrylate), poly(hexyl (meth)acrylate), poly(isodecyl(meth)acrylate), poly(lauryl (meth)acrylate), poly(phenyl(meth)acrylate), poly(methyl acrylate), poly(isopropyl acrylate), poly(isobutyl acrylate), poly(octadecyl acrylate) and copolymers and mixtures thereof, polydioxanone and its copolymers, polyhydroxyalkanoates, polypropylene fumarate, polyoxymethylene, poloxamers, poly(ortho)esters, poly(butyric acid), poly(valeric acid), poly(lactide-co-caprolactone), PEG-PLGA-PEG and trimethylene carbonate, polyvinylpyrrolidone. The lipid nanoparticle may be coated or associated with a co-polymer such as, but not limited to, a block co-polymer (such as a branched polyether-polyamide block copolymer described in International Publication No. WO2013012476, herein incorporated by reference in its entirety), and (poly(ethylene glycol))-(poly(propylene oxide))-(poly(ethylene glycol)) tri-block copolymer (see e.g., US Publication 20120121718 and US Publication 20100003337 and U.S. Pat. No. 8,263,665; each of which is herein incorporated by reference in their entirety). The co-polymer may be a polymer that is generally regarded as safe (GRAS) and the formation of the lipid nanoparticle may be in such a way that no new chemical entities are created. For example, the lipid nanoparticle may comprise poloxamers coating PLGA nanoparticles without forming new chemical entities which are still able to rapidly penetrate human mucus (Yang et al. Angew. Chem. Int. Ed. 2011 50:2597-2600; the contents of which are herein incorporated by reference in its entirety). A non-limiting scalable method to produce nanoparticles which can penetrate human mucus is described by Xu et al. (See e.g., J Control Release 2013, 170(2):279-86; the contents of which are herein incorporated by reference in its entirety).

The vitamin of the polymer-vitamin conjugate may be vitamin E. The vitamin portion of the conjugate may be substituted with other suitable components such as, but not limited to, vitamin A, vitamin E, other vitamins, cholesterol, a hydrophobic moiety, or a hydrophobic component of other surfactants (e.g., sterol chains, fatty acids, hydrocarbon chains and alkylene oxide chains).

The lipid nanoparticle engineered to penetrate mucus may include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin (34 dornase alfa, neltenexine, erdosteine) and various DNases including rhDNase. The surface altering agent may be embedded or enmeshed in the particle's surface or disposed (e.g., by coating, adsorption, covalent linkage, or other process) on the surface of the lipid nanoparticle. (see e.g., US Publication 20100215580 and US Publication 20080166414 and US20130164343; the contents of each of which is herein incorporated by reference in their entirety).

In one embodiment, the mucus penetrating lipid nanoparticles may comprise at least one polynucleotide described herein. The polynucleotide may be encapsulated in the lipid nanoparticle and/or disposed on the surface of the particle. The polynucleotide may be covalently coupled to the lipid nanoparticle. Formulations of mucus penetrating lipid nanoparticles may comprise a plurality of nanoparticles. Further, the formulations may contain particles which may interact with the mucus and alter the structural and/or adhesive properties of the surrounding mucus to decrease mucoadhesion which may increase the delivery of the mucus penetrating lipid nanoparticles to the mucosal tissue.

In another embodiment, the mucus penetrating lipid nanoparticles may be a hypotonic formulation comprising a mucosal penetration enhancing coating. The formulation may be hypotonice for the epithelium to which it is being delivered. Non-limiting examples of hypotonic formulations may be found in International Patent Publication No. WO2013110028, the contents of which are herein incorporated by reference in its entirety.

In one embodiment, in order to enhance the delivery through the mucosal barrier the NAV formulation may comprise or be a hypotonic solution. Hypotonic solutions were found to increase the rate at which mucoinert particles such as, but not limited to, mucus-penetrating particles, were able to reach the vaginal epithelial surface (See e.g., Ensign et al. Biomaterials 2013 34(28):6922-9; the contents of which is herein incorporated by reference in its entirety).

In one embodiment, the NAV is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, *Front Biosci*. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the NAV is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; the contents of which are herein incorporated by reference in its entirety). As a non-limiting example, the SLN may be the SLN described in International Patent Publication No. WO2013105101, the contents of which are herein incorporated by reference in its entirety. As another non-limiting example, the SLN may be made by the methods or processes described in International Patent Publication No. WO2013105101, the contents of which are herein incorporated by reference in its entirety.

Liposomes, lipoplexes, or lipid nanoparticles may be used to improve the efficacy of polynucleotides directed protein production as these formulations may be able to increase cell transfection by the NAV; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the polynucleotide.

In one embodiment, the NAVs of the present invention can be formulated for controlled release and/or targeted delivery. As used herein, "controlled release" refers to a pharmaceutical composition or compound release profile that conforms to a particular pattern of release to effect a therapeutic outcome. In one embodiment, the RNAVs may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention may be enclosed, surrounded or encased within the delivery agent. "Partially encapsulation" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In one embodiment, the controlled release formulation may include, but is not limited to, tri-block co-polymers. As a non-limiting example, the formulation may include two different types of tri-block co-polymers (International Pub. No. WO2012131104 and WO2012131106; the contents of each of which is herein incorporated by reference in its entirety).

In another embodiment, the NAVs may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In another embodiment, the lipid nanoparticle may be encapsulated into any polymer known in the art which may form a gel when injected into a subject. As another non-limiting example, the lipid nanoparticle may be encapsulated into a polymer matrix which may be biodegradable.

In one embodiment, the NAV formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In one embodiment, the NAV controlled release and/or targeted delivery formulation may comprise at least one degradable polyester which may contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In one embodiment, the NAV controlled release and/or targeted delivery formulation comprising at least one polynucleotide may comprise at least one PEG and/or PEG related polymer derivatives as described in U.S. Pat. No. 8,404,222, herein incorporated by reference in its entirety.

In another embodiment, the NAV controlled release delivery formulation comprising at least one polynucleotide may be the controlled release polymer system described in US20130130348, herein incorporated by reference in its entirety.

In one embodiment, the NAVs of the present invention may be encapsulated in a therapeutic nanoparticle, referred to herein as "therapeutic nanoparticle RNAVs." Therapeutic nanoparticles may be formulated by methods described herein and known in the art such as, but not limited to, International Pub Nos. WO2010005740, WO2010030763, WO2010005721, WO2010005723, WO2012054923, US Pub. Nos. US20110262491, US20100104645, US20100087337, US20100068285, US20110274759, US20100068286, US20120288541, US20130123351 and US20130230567 and U.S. Pat. Nos. 8,206,747, 8,293,276, 8,318,208 and 8,318,211; the contents of each of which are herein incorporated by reference in their entirety. In another embodiment, therapeutic polymer nanoparticles may be identified by the methods described in US Pub No. US20120140790, the contents of which is herein incorporated by reference in its entirety.

In one embodiment, the therapeutic nanoparticle NAV may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the polynucleotides of the present invention (see International Pub No. 2010075072 and US Pub No. US20100216804, US20110217377 and US20120201859, each of which is herein incorporated by reference in their entirety). In another non-limiting example, the sustained release formulation may comprise agents which permit persistent bioavailability such as, but not limited to, crystals, macromolecular gels and/or particulate suspensions (see US Patent Publication No US20130150295, the contents of which is herein incorporated by reference in its entirety).

In one embodiment, the therapeutic nanoparticle NAVs may be formulated to be target specific. As a non-limiting example, the therapeutic nanoparticles may include a corticosteroid (see International Pub. No. WO2011084518; herein incorporated by reference in its entirety). As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, each of which is herein incorporated by reference in their entirety.

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof. In another embodiment, the diblock copolymer may comprise the diblock copolymers described in European Patent Publication No. the contents of which are herein incorporated by reference in its entirety. In yet another embodiment, the diblock copolymer may be a high-X diblock copolymer such as those described in International Patent Publication No. WO2013120052, the contents of which are herein incorporated by reference in its entirety.

As a non-limiting example the therapeutic nanoparticle comprises a PLGA-PEG block copolymer (see US Pub. No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, the contents of each of which are herein incorporated by reference in its entirety). In yet another non-limiting example, the therapeutic nanoparticle is a stealth nanoparticle or a target-specific stealth nanoparticle as described in US Patent Publication No. US20130172406, the contents of which are herein incorporated by reference in its entirety.

In one embodiment, the therapeutic nanoparticle may comprise a multiblock copolymer (See e.g., U.S. Pat. Nos. 8,263,665 and 8,287,910 and US Patent Pub. No. US20130195987; the contents of each of which are herein incorporated by reference in its entirety).

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety). The NAVs of the present invention may be formulated in lipid nanoparticles comprising the PEG-PLGA-PEG block copolymer.

In one embodiment, the therapeutic nanoparticle may comprise a multiblock copolymer (See e.g., U.S. Pat. Nos. 8,263,665 and 8,287,910 and US Patent Pub. No. US20130195987; the contents of each of which are herein incorporated by reference in its entirety).

In one embodiment, the block copolymers described herein may be included in a polyion complex comprising a non-polymeric micelle and the block copolymer. (See e.g., U.S. Pub. No. 20120076836; herein incorporated by reference in its entirety).

In one embodiment, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly (acrylic acid), poly(methacrylic acid), polycyanoacrylates and combinations thereof.

In one embodiment, the therapeutic nanoparticles may comprise at least one poly(vinyl ester) polymer. The poly (vinyl ester) polymer may be a copolymer such as a random copolymer. As a non-limiting example, the random copolymer may have a structure such as those described in International Application No. WO2013032829 or US Patent Publication No US20130121954, the contents of which are herein incorporated by reference in its entirety. In one aspect, the poly(vinyl ester) polymers may be conjugated to the polynucleotides described herein. In another aspect, the poly(vinyl ester) polymer which may be used in the present invention may be those described in, herein incorporated by reference in its entirety.

In one embodiment, the therapeutic nanoparticle may comprise at least one diblock copolymer. The diblock copolymer may be, but it not limited to, a poly(lactic) acid-poly (ethylene)glycol copolymer (see e.g., International Patent Publication No. WO2013044219; herein incorporated by reference in its entirety). As a non-limiting example, the therapeutic nanoparticle may be used to treat cancer (see International publication No. WO2013044219; herein incorporated by reference in its entirety).

In one embodiment, the therapeutic nanoparticles may comprise at least one cationic polymer described herein and/or known in the art.

In one embodiment, the therapeutic nanoparticles may comprise at least one amine-containing polymer such as, but not limited to polylysine, polyethylene imine, poly(amidoamine) dendrimers, poly(beta-amino esters) (See e.g., U.S. Pat. No. 8,287,849; herein incorporated by reference in its entirety) and combinations thereof.

In another embodiment, the nanoparticles described herein may comprise an amine cationic lipid such as those described in International Patent Application No. WO2013059496, the contents of which are herein incorporated by reference in its entirety. In one aspect the cationic lipids may have an amino-amine or an amino-amide moiety.

In one embodiment, the therapeutic nanoparticles may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In another embodiment, the therapeutic nanoparticle may include a conjugation of at least one targeting ligand. The targeting ligand may be any ligand known in the art such as, but not limited to, a monoclonal antibody. (Kirpotin et al, Cancer Res. 2006 66:6732-6740; herein incorporated by reference in its entirety).

In one embodiment, the therapeutic nanoparticle may be formulated in an aqueous solution which may be used to target cancer (see International Pub No. WO2011084513 and US Pub No. US20110294717, each of which is herein incorporated by reference in their entirety).

In one embodiment, the therapeutic nanoparticle NAVs, e.g., therapeutic nanoparticles comprising at least one NAV may be formulated using the methods described by Podobinski et al in U.S. Pat. No. 8,404,799, the contents of which are herein incorporated by reference in its entirety.

In one embodiment, the NAVs may be encapsulated in, linked to and/or associated with synthetic nanocarriers. Synthetic nanocarriers include, but are not limited to, those described in International Pub. Nos. WO2010005740, WO2010030763, WO201213501, WO2012149252, WO2012149255, WO2012149259, WO2012149265, WO2012149268, WO2012149282, WO2012149301, WO2012149393, WO2012149405, WO2012149411, WO2012149454 and WO2013019669, and US Pub. Nos. US20110262491, US20100104645, US20100087337 and US20120244222, each of which is herein incorporated by reference in their entirety. The synthetic nanocarriers may be formulated using methods known in the art and/or described herein. As a non-limiting example, the synthetic nanocarriers may be formulated by the methods described in International Pub Nos. WO2010005740, WO2010030763 and WO201213501 and US Pub. Nos. US20110262491, US20100104645, US20100087337 and US2012024422, each of which is herein incorporated by reference in their entirety. In another embodiment, the synthetic nanocarrier formulations may be lyophilized by methods described in International Pub. No. WO2011072218 and U.S. Pat. No. 8,211,473; the content of each of which is herein incorporated by reference in their entirety. In yet another embodiment, formulations of the present invention, including, but not limited to, synthetic nanocarriers, may be lyophilized or reconstituted by the methods described in US Patent Publication No. US20130230568, the contents of which are herein incorporated by reference in its entirety.

In one embodiment, the synthetic nanocarriers may contain reactive groups to release the polynucleotides described herein (see International Pub. No. WO20120952552 and US Pub No. US20120171229, each of which is herein incorporated by reference in their entirety).

In one embodiment, the synthetic nanocarriers may contain an immunostimulatory agent to enhance the immune response from delivery of the synthetic nanocarrier. As a non-limiting example, the synthetic nanocarrier may comprise a Th1 immunostimulatory agent which may enhance a Th1-based response of the immune system (see International Pub No. WO2010123569 and US Pub. No. US20110223201, each of which is herein incorporated by reference in its entirety).

In one embodiment, the synthetic nanocarriers may be formulated for targeted release. In one embodiment, the synthetic nanocarrier is formulated to release the polynucleotides at a specified pH and/or after a desired time interval. As a non-limiting example, the synthetic nanoparticle may be formulated to release the NAVs after 24 hours and/or at a pH of 4.5 (see International Pub. Nos. WO2010138193 and WO2010138194 and US Pub Nos. US20110020388 and US20110027217, each of which is herein incorporated by reference in their entireties).

In one embodiment, the synthetic nanocarriers may be formulated for controlled and/or sustained release of the polynucleotides described herein. As a non-limiting example, the synthetic nanocarriers for sustained release may be formulated by methods known in the art, described herein and/or as described in International Pub No. WO2010138192 and US Pub No. 20100303850, each of which is herein incorporated by reference in their entirety.

In one embodiment, the NAV may be formulated for controlled and/or sustained release wherein the formulation comprises at least one polymer that is a crystalline side chain (CYSC) polymer. CYSC polymers are described in U.S. Pat. No. 8,399,007, herein incorporated by reference in its entirety.

In one embodiment, the synthetic nanocarrier may be formulated for use as a vaccine. In one embodiment, the synthetic nanocarrier may encapsulate at least one polynucleotide which encode at least one antigen. As a non-limiting example, the synthetic nanocarrier may include at least one antigen and an excipient for a vaccine dosage form (see International Pub No. WO2011150264 and US Pub No. US20110293723, each of which is herein incorporated by reference in their entirety). As another non-limiting example, a vaccine dosage form may include at least two synthetic nanocarriers with the same or different antigens and an excipient (see International Pub No. WO2011150249 and US Pub No. US20110293701, each of which is herein incorporated by reference in their entirety). The vaccine dosage form may be selected by methods described herein, known in the art and/or described in International Pub No. WO2011150258 and US Pub No. US20120027806, each of which is herein incorporated by reference in their entirety).

In one embodiment, the synthetic nanocarrier may comprise at least one polynucleotide which encodes at least one adjuvant. As non-limiting example, the adjuvant may comprise dimethyldioctadecylammonium-bromide, dimethyldioctadecylammonium-chloride, dimethyldioctadecylammonium-phosphate or dimethyldioctadecylammonium-acetate (DDA) and an apolar fraction or part of said apolar fraction of a total lipid extract of a *mycobacterium* (See e.g, U.S. Pat. No. 8,241,610; herein incorporated by reference in its entirety). In another embodiment, the synthetic nanocarrier may comprise at least one polynucleotide and an adjuvant. As a non-limiting example, the synthetic nanocarrier comprising and adjuvant may be formulated by the methods described in International Pub No. WO2011150240 and US Pub No. US20110293700, each of which is herein incorporated by reference in its entirety.

In one embodiment, the synthetic nanocarrier may encapsulate at least one polynucleotide which encodes a peptide, fragment or region from a virus. As a non-limiting example, the synthetic nanocarrier may include, but is not limited to, the nanocarriers described in International Pub No. WO2012024621, WO201202629, WO2012024632 and US Pub No. US20120064110, US20120058153 and US20120058154, each of which is herein incorporated by reference in their entirety.

In one embodiment, the synthetic nanocarrier may be coupled to a polynucleotide which may be able to trigger a humoral and/or cytotoxic T lymphocyte (CTL) response (See e.g., International Publication No. WO2013019669, herein incorporated by reference in its entirety).

In one embodiment, the NAV may be encapsulated in, linked to and/or associated with zwitterionic lipids. Non-limiting examples of zwitterionic lipids and methods of using zwitterionic lipids are described in US Patent Publication No. US20130216607, the contents of which are herein incorporated by reference in its entirety. In one aspect, the zwitterionic lipids may be used in the liposomes and lipid nanoparticles described herein.

In one embodiment, the NAV may be formulated in colloid nanocarriers as described in US Patent Publication No. US20130197100, the contents of which are herein incorporated by reference in its entirety.

In one embodiment, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Pub. No. 20120282343; herein incorporated by reference in its entirety.

In some embodiments, LNPs comprise the lipid KL52 (an amino-lipid disclosed in U.S. Application Publication No. 2012/0295832 expressly incorporated herein by reference in its entirety). Activity and/or safety (as measured by examining one or more of ALT/AST, white blood cell count and cytokine induction) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, NAV may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, In another embodiment, NAVs may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Exemplary microfluidic mixers may include, but are not limited to a slit interdigitial micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51; each of which is herein incorporated by reference in its entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, each of which is expressly incorporated herein by reference in their entirety.

In one embodiment, the NAV of the present invention may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In one embodiment, the NAVs of the present invention may be formulated in lipid nanoparticles created using microfluidic technology (see Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (See e.g., Abraham et al. Chaotic Mixer for Microchannels. Science, 2002 295: 647-651; which is herein incorporated by reference in its entirety).

In one embodiment, the NAVs of the present invention may be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In one embodiment, the NAVs of the invention may be formulated for delivery using the drug encapsulating microspheres described in International Patent Publication No.

WO2013063468 or U.S. Pat. No. 8,440,614, each of which is herein incorporated by reference in its entirety. The microspheres may comprise a compound of the formula (I), (II), (III), (IV), (V) or (VI) as described in International Patent Publication No. WO2013063468, the contents of which are herein incorporated by reference in its entirety. In another aspect, the amino acid, peptide, polypeptide, lipids (APPL) are useful in delivering the NAVs of the invention to cells (see International Patent Publication No. WO2013063468, the contents of which is herein incorporated by reference in its entirety).

In one embodiment, the NAVs of the invention may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles may have a diameter from about 10 to 500 nm.

In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In one aspect, the lipid nanoparticle may be a limit size lipid nanoparticle described in International Patent Publication No. WO2013059922, the contents of which are herein incorporated by reference in its entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In another aspect the limit size lipid nanoparticle may comprise a polyethylene glycol-lipid such as, but not limited to, DLPE-PEG, DMPE-PEG, DPPC-PEG and DSPE-PEG.

In one embodiment, the NAVs may be delivered, localized and/or concentrated in a specific location using the delivery methods described in International Patent Publication No. WO2013063530, the contents of which are herein incorporated by reference in its entirety. As a non-limiting example, a subject may be administered an empty polymeric particle prior to, simultaneously with or after delivering the NAVs to the subject. The empty polymeric particle undergoes a change in volume once in contact with the subject and becomes lodged, embedded, immobilized or entrapped at a specific location in the subject.

In one embodiment, the NAVs may be formulated in an active substance release system (See e.g., US Patent Publication No. US20130102545, the contents of which is herein incorporated by reference in its entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In one embodiment, the NAVs may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO2013052167, herein incorporated by reference in its entirety. As another non-limiting example, the nanoparticle described in International Patent Publication No. WO2013052167, herein incorporated by reference in its entirety, may be used to deliver the NAVs described herein.

In one embodiment, the NAVs may be formulated in porous nanoparticle-supported lipid bilayers (protocells). Protocells are described in International Patent Publication No. WO2013056132, the contents of which are herein incorporated by reference in its entirety.

In one embodiment, the NAVs described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in its entirety. As another non-limiting example, the polymer nanoparticle for oral and parenteral formulations may be made by the methods described in European Patent No. EP2073848B1, the contents of which are herein incorporated by reference in its entirety.

In another embodiment, the NAVs described herein may be formulated in nanoparticles used in imaging. The nanoparticles may be liposome nanoparticles such as those described in US Patent Publication No US20130129636, herein incorporated by reference in its entirety. As a non-limiting example, the liposome may comprise gadolinium (III)2-{4,7-bis-carboxymethyl-10-[(N,N-distearylamidomethyl-N'-amido-methyl]-1,4,7,10-tetra-azacyclododec-1-yl}-acetic acid and a neutral, fully saturated phospholipid component (see e.g., US Patent Publication No US20130129636, the contents of which is herein incorporated by reference in its entirety).

In one embodiment, the nanoparticles which may be used in the present invention are formed by the methods described in U.S. Patent Application No. US20130130348, the contents of which is herein incorporated by reference in its entirety.

The nanoparticles of the present invention may further include nutrients such as, but not limited to, those which deficiencies can lead to health hazards from anemia to neural tube defects (see e.g., the nanoparticles described in International Patent Publication No WO2013072929, the contents of which is herein incorporated by reference in its entirety). As a non-limiting example, the nutrient may be iron in the form of ferrous, ferric salts or elemental iron, iodine, folic acid, vitamins or micronutrients.

In one embodiment, the NAVs of the present invention may be formulated in a swellable nanoparticle. The swellable nanoparticle may be, but is not limited to, those described in U.S. Pat. No. 8,440,231, the contents of which is herein incorporated by reference in its entirety. As a non-limiting embodiment, the swellable nanoparticle may be used for delivery of the NAVs of the present invention to the pulmonary system (see e.g., U.S. Pat. No. 8,440,231, the contents of which is herein incorporated by reference in its entirety).

The NAVs of the present invention may be formulated in polyanhydride nanoparticles such as, but not limited to, those described in U.S. Pat. No. 8,449,916, the contents of which is herein incorporated by reference in its entirety.

The nanoparticles and microparticles of the present invention may be geometrically engineered to modulate macrophage and/or the immune response. In one aspect, the geometrically engineered particles may have varied shapes, sizes and/or surface charges in order to incorporated the polynucleotides of the present invention for targeted delivery such as, but not limited to, pulmonary delivery (see e.g., International Publication No WO2013082111, the contents of which is herein incorporated by reference in its entirety). Other physical features the geometrically engineering particles may have include, but are not limited to, fenestrations, angled arms, asymmetry and surface roughness, charge which can alter the interactions with cells and tissues. As a non-limiting example, nanoparticles of the present invention may be made by the methods described in International Publication No WO2013082111, the contents of which is herein incorporated by reference in its entirety.

In one embodiment, the nanoparticles of the present invention may be water soluble nanoparticles such as, but not limited to, those described in International Publication No. WO2013090601, the contents of which is herein incorporated by reference in its entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In one embodiment the nanoparticles of the present invention may be developed by the methods described in US Patent Publication No. US20130172406, the contents of which are herein incorporated by reference in its entirety.

In one embodiment, the nanoparticles of the present invention are stealth nanoparticles or target-specific stealth nanoparticles such as, but not limited to, those described in US Patent Publication No. US20130172406; the contents of which is herein incorporated by reference in its entirety. The nanoparticles of the present invention may be made by the methods described in US Patent Publication No. US20130172406, the contents of which are herein incorporated by reference in its entirety.

In another embodiment, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In one embodiment, the nanoparticle may be a nanoparticle-nucleic acid hybrid structure having a high density nucleic acid layer. As a non-limiting example, the nanoparticle-nucleic acid hybrid structure may made by the methods described in US Patent Publication No. US20130171646, the contents of which are herein incorporated by reference in its entirety. The nanoparticle may comprise a nucleic acid such as, but not limited to, polynucleotides described herein and/or known in the art.

At least one of the nanoparticles of the present invention may be embedded in in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013123523, the contents of which are herein incorporated by reference in its entirety.

Polymers, Biodegradable Nanoparticles, and Core-Shell Nanoparticles

The NAVs of the invention can be formulated using natural and/or synthetic polymers. Non-limiting examples of polymers which may be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.).

A non-limiting example of chitosan formulation includes a core of positively charged chitosan and an outer portion of negatively charged substrate (U.S. Pub. No. 20120258176; herein incorporated by reference in its entirety). Chitosan includes, but is not limited to N-trimethyl chitosan, mono-N-carboxymethyl chitosan (MCC), N-palmitoyl chitosan (NPCS), EDTA-chitosan, low molecular weight chitosan, chitosan derivatives, or combinations thereof.

In one embodiment, the polymers used in the present invention have undergone processing to reduce and/or inhibit the attachment of unwanted substances such as, but not limited to, bacteria, to the surface of the polymer. The polymer may be processed by methods known and/or described in the art and/or described in International Pub. No. WO2012150467, herein incorporated by reference in its entirety.

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles *Hum Gene Ther.* 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles (see e.g., US Patent Publication No. US20130156721, herein incorporated by reference in its entirety). The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res. 2005 65: 8984-8982; herein incorporated by reference in its entirety) and siRNA formulated in these nanoparticles was well tolerated in non-human primates (Heidel et al., Proc Natl Acad Sci USA 2007 104:5715-21; herein incorporated by reference in its entirety). Both of these delivery strategies incorporate rational approaches using both targeted delivery and endosomal escape mechanisms.

The polymer formulation can permit the sustained or delayed release of polynucleotides (e.g., following intramuscular or subcutaneous injection). The altered release profile for the polynucleotide can result in, for example, translation of an encoded protein over an extended period of time. The polymer formulation may also be used to increase the stability of the polynucleotide. Biodegradable polymers have been previously used to protect nucleic acids other than polynucleotide from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; each of which is herein incorporated by reference in its entirety).

In one embodiment, the NAV pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fl.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

As a non-limiting example NAVs may be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradable, biocompatible polymers which are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; each of which is herein incorporated by reference in its entirety).

The NAVs of the invention may be formulated with or in a polymeric compound. The polymer may include at least one polymer such as, but not limited to, polyethenes, polyethylene glycol (PEG), poly(l-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, elastic biodegradable polymer, biodegradable block copolymer, biodegradable random copolymer, biodegradable polyester copolymer, biodegradable polyester block copolymer, biodegradable polyester block random copolymer, multiblock copolymers, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester), acrylic polymers, amine-containing polymers, dextran polymers, dextran polymer derivatives or or combinations thereof.

As a non-limiting example, the NAVs of the invention may be formulated with the polymeric compound of PEG grafted with PLL as described in U.S. Pat. No. 6,177,274; herein incorporated by reference in its entirety. The formulation may be used for transfecting cells in vitro or for in vivo delivery of polynucleotides. In another example, the polynucleotide may be suspended in a solution or medium with a cationic polymer, in a dry pharmaceutical composition or in a solution that is capable of being dried as described in U.S. Pub. Nos. 20090042829 and 20090042825; each of which are herein incorporated by reference in their entireties.

As another non-limiting example the NAVs of the invention may be formulated with a PLGA-PEG block copolymer (see US Pub. No. US20120004293 and U.S. Pat. No. 8,236,330, herein incorporated by reference in their entireties) or PLGA-PEG-PLGA block copolymers (See U.S. Pat. No. 6,004,573, herein incorporated by reference in its entirety). As a non-limiting example, the NAVs of the invention may be formulated with a diblock copolymer of PEG and PLA or PEG and PLGA (see U.S. Pat. No. 8,246,968, herein incorporated by reference in its entirety).

A polyamine derivative may be used to deliver nucleic acids or to treat and/or prevent a disease or to be included in an implantable or injectable device (U.S. Pub. No. 20100260817 (now U.S. Pat. No. 8,460,696) the contents of each of which is herein incorporated by reference in its entirety). As a non-limiting example, a pharmaceutical composition may include the NAV and the polyamine derivative described in U.S. Pub. No. 20100260817 (now U.S. Pat. No. 8,460,696; the contents of which are incorporated herein by reference in its entirety. As a non-limiting example the NAVs of the present invention may be delivered using a polyamide polymer such as, but not limited to, a polymer comprising a 1,3-dipolar addition polymer prepared by combining a carbohydrate diazide monomer with a dilkyne unite comprising oligoamines (U.S. Pat. No. 8,236,280; herein incorporated by reference in its entirety).

The NAVs of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the NAVs of the present invention may be formulated with at least one polymer and/or derivatives thereof described in International Publication Nos. WO2011115862, WO2012082574 and WO2012068187 and U.S. Pub. No. 20120283427, each of which are herein incorporated by reference in their entireties.

In another embodiment, the NAVs of the present invention may be formulated with a polymer of formula Z as described in WO2011115862, herein incorporated by reference in its entirety. In yet another embodiment, the NAVs may be formulated with a polymer of formula Z, Z' or Z" as described in International Pub. Nos. WO2012082574 or WO2012068187 and U.S. Pub. No. 2012028342, each of which are herein incorporated by reference in their entireties. The polymers formulated with the modified RNA of the present invention may be synthesized by the methods described in International Pub. Nos. WO2012082574 or WO2012068187, each of which are herein incorporated by reference in their entireties.

The NAVs of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

Formulations of NAVs of the invention may include at least one amine-containing polymer such as, but not limited to polylysine, polyethylene imine, poly(amidoamine) dendrimers, poly(amine-co-esters) or combinations thereof. As a non-limiting example, the poly(amine-co-esters) may be the polymers described in and/or made by the methods described in International Publication No WO2013082529, the contents of which are herein incorporated by reference in its entirety.

For example, the NAVs of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made by methods known in the art and/or described in U.S. Pat. No. 6,696,038, U.S. App. Nos. 20030073619 and 20040142474 each of which is herein incorporated by reference in their entireties. The poly(alkylene imine) may be made using methods known in the art and/or as described in U.S. Pub. No. 20100004315, herein incorporated by reference in its entirety. The biodegradable polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in their entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyargine, polyornithine, histones, avidin, protamines, polylactides and poly(lactide-co-glycosides). The biodegradable cross-linked cationic multi-block copolymers may be made my methods known in the art and/or as described in U.S. Pat. Nos. 8,057,821, 8,444,992 or U.S. Pub. No. 2012009145 each of which are herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos. 6,267,987 and 6,217,912 each of which are herein incorporated by reference in their entireties.

The NAVs of the invention may be formulated with at least one degradable polyester which may contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

The NAVs of the invention may be formulated with at least one crosslinkable polyester. Crosslinkable polyesters include those known in the art and described in US Pub. No. 20120269761, the contents of which is herein incorporated by reference in its entirety.

The NAVs of the invention may be formulated in or with at least one cyclodextrin polymer. Cyclodextrin polymers and methods of making cyclodextrin polymers include those known in the art and described in US Pub. No. 20130184453, the contents of which are herein incorporated by reference in its entirety.

In one embodiment, the NAVs of the invention may be formulated in or with at least one crosslinked cation-binding polymers. Crosslinked cation-binding polymers and methods of making crosslinked cation-binding polymers include those known in the art and described in International Patent Publication No. WO2013106072, WO2013106073 and WO2013106086, the contents of each of which are herein incorporated by reference in its entirety.

In one embodiment, the NAVs of the invention may be formulated in or with at least one branched polymer. Branched polymers and methods of making branched polymers include those known in the art and described in International Patent Publication No. WO2013113071, the contents of each of which are herein incorporated by reference in its entirety.

In one embodiment, the NAVs of the invention may be formulated in or with at least PEGylated albumin polymer. PEGylated albumin polymer and methods of making PEGylated albumin polymer include those known in the art and described in US Patent Publication No. US20130231287, the contents of each of which are herein incorporated by reference in its entirety.

In one embodiment, the polymers described herein may be conjugated to a lipid-terminating PEG. As a non-limiting example, PLGA may be conjugated to a lipid-terminating PEG forming PLGA-DSPE-PEG. As another non-limiting example, PEG conjugates for use with the present invention are described in International Publication No. WO2008103276, herein incorporated by reference in its entirety. The polymers may be conjugated using a ligand conjugate such as, but not limited to, the conjugates described in U.S. Pat. No. 8,273,363, herein incorporated by reference in its entirety.

In one embodiment, the NAVs disclosed herein may be mixed with the PEGs or the sodium phosphate/sodium carbonate solution prior to administration.

In another embodiment, a polynucleotides encoding a protein of interest may be mixed with the PEGs and also mixed with the sodium phosphate/sodium carbonate solution.

In yet another embodiment, polynucleotides encoding a protein of interest may be mixed with the PEGs and a polynucleotides encoding a second protein of interest may be mixed with the sodium phosphate/sodium carbonate solution.

In one embodiment, the NAVs described herein may be conjugated with another compound. Non-limiting examples of conjugates are described in U.S. Pat. Nos. 7,964,578 and 7,833,992, each of which are herein incorporated by reference in their entireties. In another embodiment, the NAVs of the present invention may be conjugated with conjugates of formula 1-122 as described in U.S. Pat. Nos. 7,964,578 and 7,833,992, each of which are herein incorporated by reference in their entireties. The NAVs described herein may be conjugated with a metal such as, but not limited to, gold. (See e.g., Giljohann et al. Journ. Amer. Chem. Soc. 2009 131(6): 2072-2073; herein incorporated by reference in its entirety). In another embodiment, the NAVs described herein may be conjugated and/or encapsulated in gold-nanoparticles. (International Pub. No. WO201216269 and U.S. Pub. No. 20120302940 and US20130177523; the contents of each of which is herein incorporated by reference in its entirety).

As described in U.S. Pub. No. 20100004313, herein incorporated by reference in its entirety, a gene delivery composition may include a nucleotide sequence and a poloxamer. For example, the NAVs of the present invention may be used in a gene delivery composition with the poloxamer described in U.S. Pub. No. 20100004313, the contents of which are herein incorporated by reference in its entirety.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane(DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B—[N—(N',N'-Dimethylaminoethane)-carbamoyl]Cholesterol Hydrochloride (DC-Cholesterol HCl) diheptadecylamido-glycyl spermidine (DOGS), N,N-distearyl-N,N-dimethyl-ammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof. As a non-limiting example, the NAVs may be formulated with a cationic lipopolymer such as those described in U.S. Patent Application No. 20130065942, the contents of which are herein incorporated by reference in its entirety.

The NAVs of the invention may be formulated in a polyplex of one or more polymers (See e.g., U.S. Pat. No. 8,501,478, U.S. Pub. No. 20120237565 and 20120270927 and 20130149783 and International Patent Pub. No. WO2013090861; the contents of each of which is herein incorporated by reference in its entirety). As a non-limiting example, the polyplex may be formed using the noval alpha-aminoamidine polymers described in International Publication No. WO2013090861, the contents of which are herein incorporated by reference in its entirety. As another non-limiting example, the polyplex may be formed using the click polymers described in U.S. Pat. No. 8,501,478, the contents of which is herein incorporated by reference in its entirety.

In one embodiment, the polyplex comprises two or more cationic polymers. The catioinic polymer may comprise a poly(ethylene imine) (PEI) such as linear PEI. In another embodiment, the polyplex comprises p(TETA/CBA) its PEGylated analog p(TETA/CBA)-g-PEG2k and mixtures thereof (see e.g., US Patent Publication No. US20130149783, the contents of which are herein incorporated by reference in its entirety.

The NAVs of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to delivery of the NAV, may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety). As a non-limiting example, the nanoparticle may comprise a plurality of polymers such as, but not limited to hydrophilic-hydrophobic polymers (e.g., PEG-PLGA), hydrophobic polymers (e.g., PEG) and/or hydrophilic polymers (International Pub. No. WO20120225129; the contents of which is herein incorporated by reference in its entirety).

As another non-limiting example the nanoparticle comprising hydrophilic polymers for the NAVs may be those described in or made by the methods described in International Patent Publication No. WO2013119936, the contents of which are herein incorporated by reference in its entirety.

In one embodiment, the biodegradable polymers which may be used in the present invention are poly(ether-anhydride) block copolymers. As a non-limiting example, the biodegradable polymers used herein may be a block copolymer as described in International Patent Publication No WO2006063249, herein incorporated by reference in its entirety, or made by the methods described in International Patent Publication No WO2006063249, herein incorporated by reference in its entirety.

In another embodiment, the biodegradable polymers which may be used in the present invention are alkyl and cycloalkyl terminated biodegradable lipids. As a non-limiting example, the alkyl and cycloalkyl terminated biodegradable lipids may be those described in International Publication No. WO2013086322 and/or made by the methods described in International Publication No. WO2013086322; the contents of which are herein incorporated by reference in its entirety.

In yet another embodiment, the biodegradable polymers which may be used in the present invention are cationic lipids having one or more biodegradable group located in a lipid moiety. As a non-limiting example, the biodegradable lipids may be those described in US Patent Publication No. US20130195920, the contents of which are herein incorporated by reference in its entirety.

Biodegradable calcium phosphate nanoparticles in combination with lipids and/or polymers have been shown to deliver polynucleotides in vivo. In one embodiment, a lipid coated calcium phosphate nanoparticle, which may also contain a targeting ligand such as anisamide, may be used to deliver the NAV of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615; herein incorporated by reference in its entirety). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to delivery NAVs (Kazikawa et al., J Contr Rel. 2004 97:345-356; Kazikawa et al., J Contr Rel. 2006 111:368-370; the contents of each of which are herein incorporated by reference in its entirety).

In one embodiment, a PEG-charge-conversional polymer (Pitella et al., Biomaterials. 2011 32:3106-3114; the contents of which are herein incorporated by reference in its entirety) may be used to form a nanoparticle to deliver the NAVs of the present invention. The PEG-charge-conversional polymer may improve upon the PEG-polyanion block copolymers by being cleaved into a polycation at acidic pH, thus enhancing endosomal escape.

In one embodiment, a polymer used in the present invention may be a pentablock polymer such as, but not limited to, the pentablock polymers described in International Patent Publication No. WO2013055331, herein incorporated by reference in its entirety. As a non-limiting example, the pentablock polymer comprises PGA-PCL-PEG-PCL-PGA, wherein PEG is polyethylene glycol, PCL is poly(E-caprolactone), PGA is poly(glycolic acid), and PLA is poly(lactic acid). As another non-limiting example, the pentablock polymer comprises PEG-PCL-PLA-PCL-PEG, wherein PEG is polyethylene glycol, PCL is poly(E-caprolactone), PGA is poly(glycolic acid), and PLA is poly(lactic acid).

In one embodiment, a polymer which may be used in the present invention comprises at least one diepoxide and at least one aminoglycoside (See e.g., International Patent Publication No. WO2013055971, the contents of which are herein incorporated by reference in its entirety). The diepoxide may be selected from, but is not limited to, 1,4 butanediol diglycidyl ether (1,4 B), 1,4-cyclohexanedimethanol diglycidyl ether (1,4 C), 4-vinylcyclohexene diepoxide (4VCD), ethyleneglycol diglycidyl ether (EDGE), glycerol diglycidyl ether (GDE), neopentylglycol diglycidyl ether (NPDGE), poly(ethyleneglycol) diglycidyl ether (PEGDE), poly(propyleneglycol) diglycidyl ether (PPGDE) and resorcinol diglycidyl ether (RDE). The aminoglycoside may be selected from, but is not limited to, streptomycin, neomycin, framycetin, paromomycin, ribostamycin, kanamycin, amikacin, arbekacin, bekanamycin, dibekacin, tobramycin, spectinomycin, hygromycin, gentamicin, netilmicin, sisomicin, isepamicin, verdamicin, astromicin, and apramycin. As a non-limiting example, the polymers may be made by the methods described in International Patent Publication No. WO2013055971, the contents of which are herein incorporated by reference in its entirety. As another non-limiting example, compositions comprising any of the polymers comprising at least one least one diepoxide and at least one aminoglycoside may be made by the methods described in International Patent Publication No. WO2013055971, the contents of which are herein incorporated by reference in its entirety.

In one embodiment, a polymer which may be used in the present invention may be a cross-linked polymer. As a non-limiting example, the cross-linked polymers may be used to form a particle as described in U.S. Pat. No. 8,414,927, the contents of which are herein incorporated by reference in its entirety. As another non-limiting example, the cross-linked polymer may be obtained by the methods described in US Patent Publication No. US20130172600, the contents of which are herein incorporated by reference in its entirety.

In another embodiment, a polymer which may be used in the present invention may be a cross-linked polymer such as those described in U.S. Pat. No. 8,461,132, the contents of which are herein incorporated by reference in its entirety. As a non-limiting example, the cross-linked polymer may be used in a therapeutic composition for the treatment of a body tissue. The therapeutic composition may be administered to damaged tissue using various methods known in the art and/or described herein such as injection or catheterization.

In one embodiment, a polymer which may be used in the present invention may be a di-alphatic substituted pegylated lipid such as, but not limited to, those described in International Patent Publication No. WO2013049328, the contents of which are herein incorporated by reference in its entirety.

In one embodiment, a block copolymer is PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety) may be used in the present invention. The present invention may be formulated with PEG-PLGA-PEG for administration such as, but not limited to, intramuscular and subcutaneous administration.

In another embodiment, the PEG-PLGA-PEG block copolymer is used in the present invention to develop a biodegradable sustained release system. In one aspect, the NAVs of the present invention are mixed with the block copolymer prior to administration. In another aspect, the NAVs of the present invention are co-administered with the block copolymer.

In one embodiment, the polymer used in the present invention may be a multi-functional polymer derivative such as, but not limited to, a multi-functional N-maleimidyl polymer derivatives as described in U.S. Pat. No. 8,454,946, the contents of which are herein incorporated by reference in its entirety.

The use of core-shell nanoparticles has additionally focused on a high-throughput approach to synthesize cationic cross-linked nanogel cores and various shells (Siegwart et al., Proc Natl Acad Sci USA. 2011 108:12996-13001; the contents of which are herein incorporated by reference in its entirety). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containing PEG may be used to delivery of the NAV of the present invention. As a non-limiting example, in mice bearing a luciferase-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031; herein incorporated by reference in its entirety).

In one embodiment, the lipid nanoparticles may comprise a core of the NAVs disclosed herein and a polymer shell. The polymer shell may be any of the polymers described herein and are known in the art. In an additional embodiment, the polymer shell may be used to protect the polynucleotides in the core.

Core-shell nanoparticles for use with the NAVs of the present invention are described and may be formed by the methods described in U.S. Pat. No. 8,313,777 or International Patent Publication No. WO2013124867, the contents of each of which are herein incorporated by reference in their entirety.

In one embodiment, the polymer used with the formulations described herein may be a modified polymer (such as, but not limited to, a modified polyacetal) as described in International Publication No. WO2011120053, the contents of which are herein incorporated by reference in its entirety.

In one embodiment, the formulation may be a polymeric carrier cargo complex comprising a polymeric carrier and at least one nucleic acid molecule. Non-limiting examples of polymeric carrier cargo complexes are described in International Patent Publications Nos. WO2013113326, WO2013113501, WO2013113325, WO2013113502 and WO2013113736 and European Patent Publication No. EP2623121, the contents of each of which are herein incorporated by reference in their entireties. In one aspect the polymeric carrier cargo complexes may comprise a negatively charged nucleic acid molecule such as, but not limited to, those described in International Patent Publication Nos. WO2013113325 and WO2013113502, the contents of each of which are herein incorporated by reference in its entirety.

In one embodiment, a pharmaceutical composition may comprise NAVs of the invention and a polymeric carrier cargo complex. The polynucleotides may encode a protein of interest such as, but not limited to, an antigen from a pathogen associated with infectious disease, an antigen associated with allergy or allergic disease, an antigen associated with autoimmune disease or an antigen associated with cancer or tumour disease (See e.g., the antigens described in International Patent Publications Nos. WO2013113326, WO2013113501, WO2013113325, WO2013113502 and WO2013113736 and European Patent Publication No. EP2623121, the contents of each of which are herein incorporated by reference in their entireties).

As a non-limiting example, the core-shell nanoparticle may be used to treat an eye disease or disorder (See e.g. US Publication No. 20120321719, the contents of which are herein incorporated by reference in its entirety).

In one embodiment, the polymer used with the formulations described herein may be a modified polymer (such as, but not limited to, a modified polyacetal) as described in International Publication No. WO2011120053, the contents of which are herein incorporated by reference in its entirety.

Peptides and Proteins

The NAVs of the invention can be formulated with peptides and/or proteins in order to increase transfection of cells by the polynucleotide. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3):310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life Sci. 62(16):1839-49 (2005), all of which are incorporated herein by reference in their entirety). The compositions can also be formulated to include a cell penetrating agent, e.g., liposomes, which enhance delivery of the compositions to the intracellular space. NAVs of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106: 6111-6116; Sawyer, Chem Biol Drug Des. 2009 73:3-6; Verdine and Hilinski, Methods Enzymol. 2012; 503:3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the polynucleotide may be introduced.

Formulations of the including peptides or proteins may be used to increase cell transfection by the NAV, alter the biodistribution of the polynucleotide (e.g., by targeting specific tissues or cell types), and/or increase the translation of encoded protein. (See e.g., International Pub. No. WO2012110636 and WO2013123298; the contents of which are herein incorporated by reference in its entirety).

In one embodiment, the cell penetrating peptide may be, but is not limited to, those described in US Patent Publication No US20130129726, US20130137644 and US20130164219, each of which is herein incorporated by reference in its entirety.

Cells

The NAVs of the invention can be transfected ex vivo into cells, which are subsequently transplanted into a subject.

As one non-limiting example, a sample of blood from a patient or subject may be treated with an antigen or adjuvant or both where one or more are encoded by the NAVs of the invention to activate the PBMC population. This activated sample or a subset of specific cells may then be given back to the donor patient thereby activating the immune system. This activated PBMC vaccine may be designed using any of the NAVs of the present disclosure.

As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than polynucleotides have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

The NAVs may be delivered in synthetic VLPs synthesized by the methods described in International Pub No. WO2011085231 and WO2013116656 and US Pub No. 20110171248, the contents of each of which are herein incorporated by reference in their entireties.

Cell-based formulations of the NAVs of the invention may be used to ensure cell transfection (e.g., in the cellular carrier), alter the biodistribution of the polynucleotide (e.g., by targeting the cell carrier to specific tissues or cell types), and/or increase the translation of encoded protein.

Introduction into Cells

A variety of methods are known in the art and suitable for introduction of nucleic acid into a cell, including viral and non-viral mediated techniques and any of these may be used to introduce the NAVs of the present invention. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, Mass.) (e.g., the AgilePulse In Vivo System) and Inovio (Blue Bell, Pa.) (e.g., Inovio SP-5P intramuscular delivery device or the CELLECTRA® 3000 intradermal delivery device). In one embodiment, NAVs may be delivered by electroporation as described in Example 9.

Micro-Organ

The NAVs may be contained in a micro-organ which can then express an encoded polypeptide of interest in a long-lasting therapeutic formulation. In one aspect, the micro-organ may comprise a vector comprising a nucleic acid sequence (e.g., a polynucleotides of the present invention) encoding a polypeptide of interest, operably linked to one or more regulatory sequences. As a non-limiting example, the long-lasting therapeutic micro-organ used with the present invention may be those described in U.S. Pat. No. 845,948, the contents of which are herein incorporated by reference in its entirety. As another non-limiting example, the micro-organ may be used to maintain a desired level of a polypeptide of interest for a sustained period of time (e.g., maintaining physiological hemoglobin levels as described in U.S. Pat. No. 845,948, the contents of which are herein incorporated by reference in its entirety).

The micro-organ may be able to produce the polypeptide of interest for at least a day, at least two days, at least three days, at least four days, at least five days, at least six days, a least 7 days, at least 8 days, at least 9 days, at least 10 days, at least 11 days, at least 12 days, at least 13 days, at least 14 days, at least 3 weeks, at least 1 month and/or at least 2 months, at least 3 months, at least 4 months, at least 5 months, at least 6 months or greater than 6 months.

In one embodiment, the micro-organ may have a diameter of at least 0.5 mm to at least 20 mm such as, but not limited to, at least 0.5 mm, at least 1 mm, at least 1.5 mm, at least 2 mm, at least 2.5 mm, at least 3 mm, at least 3.5 mm, at least 4 mm, at least 4.5 mm, at least 5 mm, at least 5.5 mm, at least 6 mm, at least 6.5 mm, at least 7 mm, at least 7.5 mm, at least 8 mm, at least 8.5 mm, at least 9 mm, at least 9.5 mm, at least 10 mm, at least 10.5 mm, at least 11 mm, at least 11.5 mm, at least 12 mm, at least 12.5 mm, at least 13 mm, at least 13.5 mm, at least 14 mm, at least 14.5 mm, at least 15 mm, at least 15.5 mm, at least 16 mm, at least 16.5 mm, at least 17 mm, at least 17.5 mm, at least 18 mm, at least 18.5 mm, at least 19 mm, at least 19.5 mm or at least 20 mm. In another embodiment, the micro-organ may have a diameter of 0.5-2.5 mm, 1-2.5 mm, 1.5-2.5 mm, 0.5-3 mm, 1-3 mm, 1.5-3 mm, 0.5-3.5 mm, 1-3.5 mm, 1.5-3.5 mm, 0.5-4 mm, 1-4 mm, 1.5-4 mm, 2-4 mm, 0.5-5 mm, 1-5 mm, 1.5-5 mm, 2-5 mm, 2.5-5 mm, 3-5 mm, 0.5-6 mm, 1-6 mm, 1.5-6 mm, 2-6 mm, 2.5-6 mm, 3-6 mm, 3.5-6 mm, 4-6 mm, 0.5-7 mm, 1-7 mm, 1.5-7 mm, 2-7 mm, 2.5-7 mm, 3-7 mm, 3.5-7 mm, 4-7 mm, 4.5-7 mm, 5-7 mm, 0.5-8 mm, 1-8 mm, 1.5-8 mm, 2-8 mm, 2.5-8 mm, 3-8 mm, 3.5-8 mm, 4-8 mm, 4.5-8 mm, 5-8 mm, 5.5-8 mm, 6-8 mm, 0.5-9 mm, 1-9 mm, 1.5-9 mm, 2-9 mm, 2.5-9 mm, 3-9 mm, 3.5-9 mm, 4-9 mm, 4.5-9 mm, 5-9 mm, 5.5-9 mm, 6-9 mm, 6.5-9 mm, 7-9 mm, 0.5-10 mm, 1-10 mm, 1.5-10 mm, 2-10 mm, 2.5-10 mm, 3-10 mm, 3.5-10 mm, 4-10 mm, 4.5-10 mm, 5-10 mm, 5.5-10 mm, 6-10 mm, 6.5-10 mm, 7-10 mm, 7.5-10 nm or 8-10 nm.

In one embodiment, the micro-organ may have a length of at least 2 mm to at least 150 mm such as, but not limited to, at least 2 mm, at least 3 mm, at least 4 mm, at least 5 mm, at least 6 mm, at least 7 mm, at least 8 mm, at least 9 mm, at least 10 mm, at least 15 mm, at least 20 mm, at least 25 mm, at least 30 mm, at least 35 mm, at least 40 mm, at least 45 mm, at least 50 mm, at least 55 mm, at least 60 mm, at least 65 mm, at least 70 mm, at least 75 mm, at least 80 mm, at least 85 mm, at least 90 mm, at least 95 mm, at least 100 mm, at least 105 mm, at least 110 mm, at least 115 mm, at least 120 mm, at least 125 mm, at least 130 mm, at least 135 mm, at least 140 mm, at least 145 mm or at least 150 mm. In another embodiment, the micro-organ may have a length of 5-100 mm, 10-100 mm, 15-100 mm, 20-100 mm, 25-10 mm, 30-100 mm, 35-100 mm, 40-100 mm, 45-100 mm, 50-100 mm, 55-100 mm, 60-100 mm, 65-100 mm, 70-100 mm, 75-100 mm, 80-100 mm, 85-100 mm, 90-100 mm, 5-90 mm, 10-90 mm, 15-90 mm, 20-90 mm, 25-10 mm, 30-90 mm, 35-90 mm, 40-90 mm, 45-90 mm, 50-90 mm, 55-90 mm, 60-90 mm, 65-90 mm, 70-90 mm, 75-90 mm, 80-90 mm, 5-80 mm, 10-80 mm, 15-80 mm, 20-80 mm, 25-10 mm, 30-80 mm, 35-80 mm, 40-80 mm, 45-80 mm, 50-80 mm, 55-80 mm, 60-80 mm, 65-80 mm, 70-80 mm, 5-70 mm, 10-70 mm, 15-70 mm, 20-70 mm, 25-10 mm, 30-70 mm, 35-70 mm, 40-70 mm, 45-70 mm, 50-70 mm, 55-70 mm, 60-70 mm, 5-60 mm, 10-60 mm, 15-60 mm, 20-60 mm, 25-10 mm, 30-60 mm, 35-60 mm, 40-60 mm, 45-60 mm, 50-60 mm, 5-50 mm, 10-50 mm, 15-50 mm, 20-50 mm, 25-10 mm, 30-50 mm, 35-50 mm, 40-50 mm, 5-40 mm, 10-40 mm, 15-40 mm, 20-40 mm, 25-10 mm, 30-40 mm, 5-30 mm, 10-30 mm, 15-30 mm, 20-30 mm, 5-20 mm, 10-20 mm or 5-10 mm.

Hyaluronidase

The intramuscular or subcutaneous localized injection of NAVs of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a polynucleotide of the invention administered intramuscularly or subcutaneously.

Nanoparticle Mimics

The NAVs of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the NAVs of the invention may be encapsulated in a non-viron particle which can mimic the delivery function of a virus (see International Pub. No. WO2012006376 and US Patent Publication No. US20130171241 and US20130195968, the contents of each of which are herein incorporated by reference in its entirety).

Nanotubes

The NAVs of the invention can be attached or otherwise bound to at least one nanotube such as, but not limited to, rosette nanotubes, rosette nanotubes having twin bases with a linker, carbon nanotubes and/or single-walled carbon nanotubes, The NAVs may be bound to the nanotubes through forces such as, but not limited to, steric, ionic, covalent and/or other forces.

In one embodiment, the nanotube can release one or more NAVs into cells. The size and/or the surface structure of at least one nanotube may be altered so as to govern the interaction of the nanotubes within the body and/or to attach or bind to the NAVs disclosed herein. In one embodiment, the building block and/or the functional groups attached to the building block of the at least one nanotube may be altered to adjust the dimensions and/or properties of the nanotube. As a non-limiting example, the length of the nanotubes may be altered to hinder the nanotubes from passing through the holes in the walls of normal blood vessels but still small enough to pass through the larger holes in the blood vessels of tumor tissue.

In one embodiment, at least one nanotube may also be coated with delivery enhancing compounds including polymers, such as, but not limited to, polyethylene glycol. In another embodiment, at least one nanotube and/or the NAVs may be mixed with pharmaceutically acceptable excipients and/or delivery vehicles.

In one embodiment, the NAVs are attached and/or otherwise bound to at least one rosette nanotube. The rosette nanotubes may be formed by a process known in the art and/or by the process described in International Publication No. WO2012094304, herein incorporated by reference in its entirety. At least one NAV may be attached and/or otherwise bound to at least one rosette nanotube by a process as described in International Publication No. WO2012094304, herein incorporated by reference in its entirety, where rosette nanotubes or modules forming rosette nanotubes are mixed in aqueous media with at least one NAV under conditions which may cause at least one RNAVs to attach or otherwise bind to the rosette nanotubes.

In one embodiment, the NAVs may be attached to and/or otherwise bound to at least one carbon nanotube. As a non-limiting example, the NAVs may be bound to a linking agent and the linked agent may be bound to the carbon nanotube (See e.g., U.S. Pat. No. 8,246,995; herein incorporated by reference in its entirety). The carbon nanotube may be a single-walled nanotube (See e.g., U.S. Pat. No. 8,246,995; herein incorporated by reference in its entirety).

Conjugates

The NAVs of the invention include conjugates, such as a polynucleotide covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference in their entireties.

In one embodiment, the conjugate of the present invention may function as a carrier for the NAVs of the present invention. The conjugate may comprise a cationic polymer such as, but not limited to, polyamine, polylysine, polyalkylenimine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

A non-limiting example of a method for conjugation to a substrate is described in US Patent Publication No. US20130211249, the contents of which are herein incorporated by reference in its entirety. The method may be used to make a conjugated polymeric particle comprising a NAV.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

As a non-limiting example, the targeting group may be a glutathione receptor (GR)-binding conjugate for targeted delivery across the blood-central nervous system barrier (See e.g., US Patent Publication No. US2013021661012, the contents of which are herein incorporated by reference in its entirety.

In one embodiment, the conjugate of the present invention may be a synergistic biomolecule-polymer conjugate. The synergistic biomolecule-polymer conjugate may be long-acting continuous-release system to provide a greater therapeutic efficacy. The synergistic biomolecule-polymer conjugate may be those described in US Patent Publication No. US20130195799, the contents of which are herein incorporated by reference in its entirety.

In another embodiment, the conjugate which may be used in the present invention may be an aptamer conjugate. Non-limiting examples of apatamer conjugates are described in International Patent Publication No. WO2012040524, the contents of which are herein incorporated by reference in its entirety. The aptamer conjugates may be used to provide targerted delivery of formulations comprising NAVs.

In one embodiment, the conjugate which may be used in the present invention may be an amine containing polymer conjugate. Non-limiting examples of amine containing polymer conjugate are described in U.S. Pat. No. 8,507,653, the contents of which are herein incorporated by reference in its entirety. The factor IX moiety polymer conjugate may be comprise releasable linkages to release the NAVs upon and/or after delivery to a subject.

In one embodiment, pharmaceutical compositions of the present invention may include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include polynucleotides with phosphorothioate backbones and oligonucleosides with other modified backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N ($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucleotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$OCH$_3$, O($CH_2$)$_n$NH$_2$, O($CH_2$)$_n$$CH_3$, O($CH_2$)$_n$ONH$_2$, and O($CH_2$)$_n$ON[($CH_2$)$_n$$CH_3$)]$_2$, where n and m are from 1 to about 10. In other embodiments, the polynucleotides include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chin. Acta, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. Polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920; the contents of each of which is herein incorporated by reference in their entirety.

In one embodiment, the NAVs may be conjugated to an agent to enhance delivery. As a non-limiting example, the agent may be a monomer or polymer such as a targeting monomer or a polymer having targeting blocks as described in International Publication No. WO2011062965, herein incorporated by reference in its entirety. In another non-limiting example, the agent may be a transport agent covalently coupled to the polynucleotides of the present invention (See e.g., U.S. Pat. Nos. 6,835,393 and 7,374,778, each of which is herein incorporated by reference in its entirety). In yet another non-limiting example, the agent may be a membrane barrier transport enhancing agent such as those described in U.S. Pat. Nos. 7,737,108 and 8,003,129, each of which is herein incorporated by reference in its entirety.

In another embodiment, polynucleotides may be conjugated to SMARTT POLYMER TECHNOLOGY® (PHASERX®, Inc. Seattle, Wash.).

In another aspect, the conjugate may be a peptide that selectively directs the nanoparticle to neurons in a tissue or organism. As a non-limiting example, the peptide used may be, but is not limited to, the peptides described in US Patent Publication No US20130129627, herein incorporated by reference in its entirety.

In yet another aspect, the conjugate may be a peptide that can assist in crossing the blood-brain barrier.

Self-Assembled Nanoparticles

Nucleic Acid Self-Assembled Nanoparticles

Self-assembled nanoparticles have a well-defined size which may be precisely controlled as the nucleic acid strands may be easily reprogrammable. For example, the optimal particle size for a cancer-targeting nanodelivery carrier is 20-100 nm as a diameter greater than 20 nm avoids renal clearance and enhances delivery to certain tumors through enhanced permeability and retention effect. (Lee et al., Nature Nanotechnology 2012 7:389-393; herein incorporated by reference in its entirety). Such self-assembling nanoparticles may be useful in formulating the NAVs of the invention.

In one embodiment, the NAVs disclosed herein may be formulated as self-assembled nanoparticles. As a non-limiting example, nucleic acids may be used to make nanoparticles which may be used in a delivery system for the NAVs of the present invention (See e.g., International Pub. No. WO2012125987; herein incorporated by reference in its entirety).

In one embodiment, the nucleic acid self-assembled nanoparticles may comprise a core of the NAVs disclosed herein and a polymer shell. The polymer shell may be any of the polymers described herein and are known in the art. In an additional embodiment, the polymer shell may be used to protect the NAVs in the core.

The metallic nanoparticle which may be used in the present invention may be a pH-sensitive nanoparticle such as, but not limited to, those described in US Patent Publication No US20130138032, herein incorporated by reference in its entirety.

In one aspect, the metallic and/or metal-allow nanoparticles may be made by the methods described in US Patent Publication No US20130133483, herein incorporated by reference in its entirety Polymer-Based Self-Assembled Nanoparticles Polymers may be used to form sheets which self-assembled into nanoparticles. These nanoparticles may be used to deliver the NAVs of the present invention. In one embodiment, these self-assembled nanoparticles may be microsponges formed of long polymers of RNA hairpins which form into crystalline 'pleated' sheets before self-assembling into microsponges. These microsponges are densely-packed sponge like microparticles which may function as an efficient carrier and may be able to deliver cargo to a cell. The microsponges may be from 1 um to 300 nm in diameter. The microsponges may be complexed with other agents known in the art to form larger microsponges. As a non-limiting example, the microsponge may be complexed with an agent to form an outer layer to promote cellular uptake such as polycation polyethyleneime (PEI). This complex can form a 250-nm diameter particle that can remain stable at high temperatures (150° C.) (Grabow and Jaegar, Nature Materials 2012, 11:269-269; herein incorporated by reference in its entirety). Additionally these micro sponges may be able to exhibit an extraordinary degree of protection from degradation by ribonucleases.

In another embodiment, the polymer-based self-assembled nanoparticles such as, but not limited to, microsponges, may be fully programmable nanoparticles. The geometry, size and stoichiometry of the nanoparticle may be precisely controlled to create the optimal nanoparticle for delivery of cargo such as, but not limited to, NAVs.

In yet another embodiment, the polymer based nanoparticle may comprise a non-nucleic acid polymer comprising a plurality of heterogenous monomers such as those described in International Publication No. WO2013009736, the contents of which are herein incorporated by reference in its entirety.

Self-Assembled Macromolecules

The NAVs may be formulated in amphiphilic macromolecules (AMs) for delivery. AMs comprise biocompatible amphiphilic polymers which have an alkylated sugar backbone covalently linked to poly(ethylene glycol). In aqueous solution, the AMs self-assemble to form micelles. Non-limiting examples of methods of forming AMs and AMs are described in US Patent Publication No. US20130217753, the contents of which are herein incorporated by reference in its entirety.

Inorganic Nanoparticles

The NAVs of the present invention may be formulated in inorganic nanoparticles (U.S. Pat. No. 8,257,745, herein incorporated by reference in its entirety). The inorganic nanoparticles may include, but are not limited to, clay substances that are water swellable. As a non-limiting example, the inorganic nanoparticle may include synthetic smectite clays which are made from simple silicates (See e.g., U.S. Pat. Nos. 5,585,108 and 8,257,745 each of which are herein incorporated by reference in their entirety).

In one embodiment, the inorganic nanoparticles may comprise a core of the NAVs disclosed herein and a polymer shell. The polymer shell may be any of the polymers described herein and are known in the art. In an additional embodiment, the polymer shell may be used to protect the NAVs in the core.

Semi-Conductive and Metallic Nanoparticles

The NAVs of the present invention may be formulated in water-dispersible nanoparticle comprising a semiconductive or metallic material (U.S. Pub. No. 20120228565; herein incorporated by reference in its entirety) or formed in a magnetic nanoparticle (U.S. Pub. No. 20120265001 and 20120283503; each of which is herein incorporated by reference in its entirety). The water-dispersible nanoparticles may be hydrophobic nanoparticles or hydrophilic nanoparticles.

In one embodiment, the semi-conductive and/or metallic nanoparticles may comprise a core of the NAVs disclosed herein and a polymer shell. The polymer shell may be any of the polymers described herein and are known in the art. In an additional embodiment, the polymer shell may be used to protect the NAVs in the core.

Surgical Sealants: Gels and Hydrogels

In one embodiment, the NAVs disclosed herein may be encapsulated into any hydrogel known in the art which may form a gel when injected into a subject. Hydrogels are a network of polymer chains that are hydrophilic, and are sometimes found as a colloidal gel in which water is the dispersion medium. Hydrogels are highly absorbent (they can contain over 99% water) natural or synthetic polymers. Hydrogels also possess a degree of flexibility very similar to natural tissue, due to their significant water content. The hydrogel described herein may used to encapsulate lipid nanoparticles which are biocompatible, biodegradable and/or porous. A hydrogel can be made in situ from solution injection or implanted.

As a non-limiting example, the hydrogel may be an aptamer-functionalized hydrogel. The aptamer-functionalized hydrogel may be programmed to release one or more polynucleotides using nucleic acid hybridization. (Battig et al., J. Am. Chem. Society. 2012 134:12410-12413; the contents of which is herein incorporated by reference in its entirety).

As another non-limiting example, the hydrogel may be a shaped as an inverted opal. The opal hydrogels exhibit higher swelling ratios and the swelling kinetics is an order of magnitude faster than conventional hydrogels as well. Methods of producing opal hydrogels and description of opal hydrogels are described in International Pub. No. WO2012148684, the contents of which is herein incorporated by reference in its entirety.

In yet another non-limiting example, the hydrogel may be an antibacterial hydrogel. The antibacterial hydrogel may comprise a pharmaceutical acceptable salt or organic material such as, but not limited to pharmaceutical grade and/or medical grade silver salt and aloe vera gel or extract. (International Pub. No. WO2012151438, the contents of which are herein incorporated by reference in its entirety).

In one embodiment, a NAV may be encapsulated in a lipid nanoparticle and then the lipid nanoparticle may be encapsulated into a hydrogel.

In one embodiment, the NAVs disclosed herein may be encapsulated into any gel known in the art. As a non-limiting example the gel may be a fluorouracil injectable gel or a fluorouracil injectable gel containing a chemical compound and/or drug known in the art. As another example, the NAVs may be encapsulated in a fluorouracil gel containing epinephrine (See e.g., Smith et al. Cancer Chemotherapy and Pharmacology, 1999 44(4):267-274; the contents of which are herein incorporated by reference in its entirety).

In one embodiment, the NAVs disclosed herein may be encapsulated into a fibrin gel, fibrin hydrogel or fibrin glue.

In another embodiment, the NAVs may be formulated in a lipid nanoparticle or a rapidly eliminated lipid nanoparticle prior to being encapsulated into a fibrin gel, fibrin hydrogel or a fibrin glue. In yet another embodiment, the NAVs may be formulated as a lipoplex prior to being encapsulated into a fibrin gel, hydrogel or a fibrin glue. Fibrin gels, hydrogels and glues comprise two components, a fibrinogen solution and a thrombin solution which is rich in calcium (See e.g., Spicer and Mikos, Journal of Controlled Release 2010. 148: 49-55; Kidd et al. Journal of Controlled Release 2012. 157:80-85; each of which is herein incorporated by reference in its entirety). The concentration of the components of the fibrin gel, hydrogel and/or glue can be altered to change the characteristics, the network mesh size, and/or the degradation characteristics of the gel, hydrogel and/or glue such as, but not limited to changing the release characteristics of the fibrin gel, hydrogel and/or glue. (See e.g., Spicer and Mikos, Journal of Controlled Release 2010. 148: 49-55; Kidd et al. Journal of Controlled Release 2012. 157:80-85; Catelas et al. Tissue Engineering 2008. 14:119-128; each of which is herein incorporated by reference in its entirety). This feature may be advantageous when used to deliver the modified mRNA disclosed herein. (See e.g., Kidd et al. Journal of Controlled Release 2012. 157:80-85; Catelas et al. Tissue Engineering 2008. 14:119-128; each of which is herein incorporated by reference in its entirety).

In one embodiment, the NAVs disclosed herein may be used with hydrogels such as, but not limited to, the hydrogels described in U.S. Patent Application No. 20130071450 or 20130211249, the contents of each of which is herein incorporated by reference in its entirety.

As a non-limiting example, the hydrogels which may be used in the present invention may be made by the methods described in International Patent Publication No. WO2013124620, the contents of which are herein incorporated by reference in its entirety.

In another embodiment, the NAVs disclosed herein may be formulated for transdermal delivery. The formulation may comprise at least one hydrogel described in U.S. Patent Application No. 20130071450, the contents of which are herein incorporated by reference in its entirety.

In one embodiment, the hydrogel which may be used in the present invention is described in U.S. Pat. No. 8,420,605, U.S. Pat. No. 8,415,325 and/or International Patent Publication No. WO2013091001 and WO2013124620, the contents of each of which are herein incorporated by reference in its entirety.

In one embodiment, the hydrogel which may be used in the present invention may be, but is not limited to, ATRIGEL® (QLT Inc. Vancouver, British Columbia), chitosan, aliginate, collagen or hyaluronic acid hydrogel.

In another embodiment, the hydrogel which may be used in the present invention is a crosslinked methacrylate. As a non-limiting example, the hydrogel of the present invention may be used in wound dressings.

The hydrogel which may be used in the present invention may also be complexed with agents and excipients described herein including, but not limited to PEI, PVA, poly-lysine, Poloxamer 124, Poloxamer 181, Poloxamer 182, Poloxamer 407, Poloxamer 237, Poloxamer 331 and Poloxamer 338. Complexing the hydrogel with agents and/or excipients may help improve mRNA stability and uptake in a cell, tissue and/or organism. As a non-limiting example, a hydrogel may be complexed with Poloxamer 188 to improve the stability and uptake of mRNA.

In one embodiment, the NAVs disclosed herein may be formulated in a surgical sealant. The surgical sealant may be, but is not limited to, fibrinogen polymer based sealants (Ethicon Inc. Cornelia, Ga.), TISSELL® (Baxter International, Inc Deerfield, Ill.) or PEG-based sealants such as, but not limited to, COSEAL® (Baxter International, Inc Deerfield, Ill.) and DURASEAL™ (trilysine amine/PEG-ester) (Covidien, Waltham, Mass.).

In one embodiment, NAVs may be formulated in COSEAL® or co-administered with or administered after a cell, tissue or organism is administered COSEAL®. COSEAL® comprises two synthetic polyethylene glycols (PEGs) (pentaerythritol PEG ester tetra-succinimidyl and pentaerythritol PEG ether tetra-thiol), a dilute hydrogen chloride solution, and a sodium phosphate/sodium carbonate solution. The PEGs are kept separate from the sodium phosphate/sodium carbonate solution in the dilute hydrogen chloride solution until administration. After administration a hydrogel is formed, which may adhere to tissue, and forms a stiff gel in seconds which is resorbed within 30 days.

In another embodiment, the NAVs disclosed herein may be formulated in a hydrogel comprising a macromolecular matrix. The macromolecular matrix may comprise a hyaluronic acid component which may be crosslinked to a collagen component. The hydrogel used in the present invention may be, but is not limited to, the hydrogels described in International Patent Publication No. WO2013106715, the contents of which are herein incorporated by reference in its entirety.

In yet another embodiment, the NAVs disclosed herein may be formulated in a chitosan glycerophosphate (CGP) hydrogel. The formulation may further comprise a chitosanase in an effect amount to dissolve the CGP hydrogel and release the NAVs associated with the CGP hydrogel. As a non-limiting example, the NAVs may be formulated in the controlled release delivery system comprising a CGP hydrogel described in US Patent Publication No. US20130189241, the contents of which are herein incorporated by reference in its entirety.

In one embodiment, the NAVs disclosed herein may be formulated in a hydrogel formulated for controlled release such as, but not limited to, the porous matrix composites and formulations described in US Patent Publication No. US20130196915, the contents of which are herein incorporated by reference in its entirety.

In another embodiment, the NAVs disclosed herein may be formulated in a hydrogel comprising heterobifunctional poly(alkylene oxides) which may have degradable linkages. Non-limiting examples of heterobifunctional poly(alkylene oxides) are described in U.S. Pat. No. 8,497,357, the contents of which are herein incorporated by reference in its entirety.

In yet another embodiment, the NAVs may be formulated in a hydrogel which may be used as an insulin delivery system. As a non-limiting example, the hydrogel may be a glucose binding amphiphilic peptide hydrogel as described in International Patent Publication No. WO2013123491, the contents of which are herein incorporated by reference in its entirety. As another non-limiting example, the hydrogel may be a microgel such as the glucose-responsive microgels described in International Patent Publication No. WO2013123492, the contents of which are herein incorporated by reference in its entirety.

In one embodiment, the NAVs may be formulated in a hydrogel system such as, but not limited to, a multi-compartment hydrogel. A non-limiting example of a multi-compartment hydrogel and methods of making the hydrogel is described in International Patent Publication No. WO2013124855, the contents of which are herein incorporated by reference in its entirety. The multi-compartment hydrogel may be used to repair or regenerate damaged tissue in a subject.

In another embodiment, the NAVs may be formulated in a cucurbituril-based hydrogel. A non-limiting example of a cucurbituril-based hydrogel is described in international Patent Publication No. WO2013124654, the contents of which are herein incorporated by reference in its entirety.

In one embodiment, the NAVs disclosed herein may be formulated in a PEG-based surgical sealant or hydrogel.

In one embodiment, the surgical sealant or hydrogel may include at least one, at least two, at least three, at least four, at least five, at least six or more than six PEG lipids. The PEG lipids may be selected from, but are not limited to, pentaerythritol PEG ester tetra-succinimidyl and pentaerythritol PEG ether tetra-thiol, PEG-c-DOMG, PEG-DMG (1,2-Dimyristoyl-sn-glycerol, methoxypolyethylene Glycol), PEG-DS G (1,2-Distearoyl-sn-glycerol, methoxypolyethylene Glycol), PEG-DPG (1,2-Dipalmitoyl-sn-glycerol, methoxypolyethylene glycol), PEG-DSA (PEG coupled to 1,2-distearyloxypropyl-3-amine), PEG-DMA (PEG coupled to 1,2-dimyristyloxypropyl-3-amine, PEG-c-DNA, PEG-c-DMA, PEG-S-DSG, PEG-c-DMA, PEG-DPG, PEG-DMG 2000 and those described herein and/or known in the art. The concentration and/or ratio of the PEG lipids in the surgical sealant or hydrogel may be varied in order to optimize the formulation for delivery and/or administration.

The amount of buffer and/or acid used in combination with the PEG lipids of the surgical sealant or hydrogel may also be varied. In one non-limiting example, the ratio of buffer and/or acid with PEG lipids is 1:1. As a non-limiting example, the amount of buffer and/or acid used with the PEG lipids may be increased to alter the ratio of buffer/acid to PEG in order to optimize the surgical sealant or hydrogel. As another non-limiting example, the amount of buffer and/or acid used with the PEG lipids may be decreased to alter the ratio of buffer/acid to PEG in order to optimize the surgical sealant or hydrogel.

The amount of NAVs loaded into the buffer, acid and/or PEG lipid may be varied. The amount of NAVs loaded into the buffer, acid and/or PEG lipid may be, but is not limited to, at least 1 uL, at least 2 uL, at least 5 uL, at least 10 uL, at least 15 uL, at least 20 uL, at least 25 uL, at least 30 uL, at least 35 uL, at least 40 uL, at least 45 ul, at least 50 uL, at least 55 uL, at least 60 uL, at least 65 uL, at least 70 uL, at least 75 uL, at least 80 uL, at least 85 uL, at least 90 uL, at least 100 uL, at least 125 uL, at least 150 uL, at least 200 uL, at least 250 uL, at least 300 uL, at least 350 uL, at least 400 uL, at least 450 uL, at least 500 uL or more than 500 uL.

In one embodiment, the NAVs of the present invention may be loaded in PEGs and also in the buffer or the acid. The amount of NAVs loaded in the PEG may be the same, greater or less than the amount loaded in the buffer or acid. In another embodiment, the NAVs may be formulated, by the methods described herein and/or known in the art, prior to loading in the PEGs, buffer or acid.

A non-limiting example of a PEG-based hydrogel which may be used in the present invention is described in U.S. Pat. No. 8,524,215, the contents of which is herein incorporated by reference in its entirety. The PEG-based hydrogel may be an absorbable hydrogel prepared from a multi-arm PEG-vinylsulfone having about 3 to about 8 arms and a multi-arm-PEG-R-sulfhydryl having about 3 to about 8 arms (See e.g., U.S. Pat. No. 8,524,215). In one embodiment, the PEG-based hydrogel may be an absorbable hydrogel. While not wishing to be bound by theory, an absorbable PEG-based hydrogel may be beneficial to reduce the permanent chronic foreign body reaction since the absorbable hydrogel can be absorbed and passed by the body.

In one embodiment, the hydrogel may be a thermosensitive hydrogel. In one aspect the thermosensitive hydrogel may be, but is not limited to, a triblock polymer such as those described herein and known in the art. As a non-limiting example, the tri-block polymer may be PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety). As a non-limiting example, the thermosensitive hydrogel may be used to make nanoparticles and liposomes by the methods described in International Publication No. WO2013123407, the contents of which are herein incorporated by reference in its entirety.

In another embodiment, the hydrogel may be a biodegradable copolymer hydrogel (see e.g., the biodegradable hydrogels described by Nguyen and Lee (Injectable Biodegradable Hydrogels. Macromolecular Bioscience. 2010 10:563-579), herein incorporated by reference in its entirety). These hydrogels may exhibit a sol-gel phase transition that respond to external stimuli such as, but not limited to, temperature changes, pH alternations or both. Non-limiting examples of biodegradable copolymer hydrogels include triblock copolymers PEG-PLLA-PEG, PEG-PLA-PEG (see e.g., Chang et al., Non-ionic amphiphilic biodegradable PEG-PLGA-PEG copolymer enhances gene delivery efficiency in rat skeletal muscle. J Controlled Release. 2007 118:245-253, herein incorporated by reference in its entirety), PLGA-PEG-PLGA, PEG-PCL-PEG, PCL-PEG-PCL, polyesters such as poly[(R)-3-hydroxybutyrate] (PHB), polyphosphazenes such as L-sioleucine ethyl ester (IleOEt), D,L-leucine ethyl ester (LeuOEt), L-valine ethyl ester (ValOEt), or di-, tri- and oligo-peptides, polypeptides and chitosan. Temperature and pH sensitive polymers which may be used to form the biodegradable copolymer hydrogels include, but are not limited to, sulfamethazine-, poly(β-amino ester)-, poly(amino urethane)-, and poly(amidoamine)-based polymers. Formulations of the biodegradable copolymer hydrogels and NAVs may be administered using site-specific control of release behavior.

In one embodiment, the hydrogel used in the present invention may be a PEG based hydrogel such as, but not limited to, those described in International Patent Publication No WO2013082590, herein incorporated by reference in its entirety. The PEG based hydrogel may have, but is not limited to, an overall polymer weight concentration of less than or equal to 50% at the time of curing. As a non-limiting example, the PEG based hydrogel may be made by the methods described in International Patent Publication No WO2013082590, the contents of which are herein incorporated by reference in its entirety.

In another embodiment, the NAVs may be formulated in a nanostructured gel composition. The nanostructured gel may be capable of controlled release of the encapsulated NAVs. Non-limiting examples of nanostructed gels or self-assembled gels are described in International Patent Publication No. WO2012040623, the contents of which are herein incorporated by reference in its entirety.

In one embodiment, the concentration of the NAVs of the present invention in the surgical sealants, gels and/or hydrogels may be selected to provide a dosage within the range to have the desired therapeutic effect.

In one embodiment, the concentration of the polynucleotides of the NAV of the present invention in the surgical sealants, gels and/or hydrogels may be at least 0.001 mg to at least 150 mg in at least 0.1 ml to at least 30 ml of the surgical sealant, gel or hydrogel. The concentration of the polynucleotides of the present invention may be at least 0.001 mg, at least 0.005 mg, at least 0.01 mg, at least 0.05 mg, at least 0.1 mg, at least 0.5 mg, at least 1 mg, at least 5 mg, at least 7 mg, at least 10 mg, at least 12, at least 15 mg, at least 17 mg, at least 20 mg, at least 22 mg, at least 25 mg, at least 27 mg, at least 30 mg, at least 32 mg, at least 35 mg, at least 40 mg, at least 45 mg, at least 50 mg, at least 55 mg, at least 60 mg, at least 65 mg, at least 70 mg, at least 75 mg, at least 80 mg, at least 85 mg, at least 90 mg, at least 95 mg, at least 100 mg, at least 105 mg, at least 110 mg, at least 115 mg, at least 120 mg, at least 125 mg, at least 130 mg, at least 135 mg, at least 140 mg, at least 145 mg or at least 150 mg in at least 0.1 ml, at least 0.2 ml, at least 0.3 ml, at least 0.4 ml, at least 0.5 ml, at least 0.6 ml, at least 0.7 ml, at least 0.8 ml, at least 0.9 ml, at least 1 ml, at least 2 ml, at least 3 ml, at least 4 ml, at least 5 ml, at least 6 ml, at least 7 ml, at least 8 ml, at least 9 ml, at least 10 ml, at least 11 ml, at least 12 ml, at least 13 ml, at least 14 ml, at least 15 ml, at least 16 ml, at least 17 ml, at least 18 ml, at least 19 ml, at least 20 ml, at least 21 ml, at least 22 ml, at least 23 ml, at least 24 ml, at least 25 ml, at least 26 ml, at least 27 ml, at least 28 ml, at least 29 ml or at least 30 ml of the surgical sealant, gel or hydrogel.

In another embodiment, concentration of the polynucleotides of the NAV of the present invention in the surgical sealants, gels and/or hydrogels may be at least 0.001 mg/ml at least 0.005 mg/ml, at least 0.01 mg/ml, at least 0.05 mg/ml, at least 0.1 mg/ml, at least 0.5 mg/ml, at least 1 mg/ml, at least 5 mg/ml, at least 7 mg/ml, at least 10 mg/ml, at least 12, at least 15 mg/ml, at least 17 mg/ml, at least 20 mg/ml, at least 22 mg/ml, at least 25 mg/ml, at least 27 mg/ml, at least 30 mg/ml, at least 32 mg/ml, at least 35 mg/ml, at least 40 mg/ml, at least 45 mg/ml or at least 50 mg/ml.

Technology allowing for large subcutaneous infusion volumes which are known in the art, such as, but not limited to, HYLENEX® (Halozyme Therapeutics, San Diego, Calif.) may also be used. The dispersion and/or adsorption of the modified mRNA described herein may be increased with the use of HYLENEX® as HYLENEX® temporarily breaks down hyaluronic acid causing a temporty degradation in the subcutaneous space (for about 24 hours) just beneath the outside surface of the skin opening microscopic channels and allowing fluid or drugs to be dispersed and absorbed in the body.

Suspension Formulations

In some embodiments, suspension formulations are provided comprising NAVs, water immiscible oil depots, surfactants and/or co-surfactants and/or co-solvents. Combinations of oils and surfactants may enable suspension formulation with NAVs. Delivery of NAVs in a water immiscible depot may be used to improve bioavailability through sustained release of NAVs from the depot to the surrounding physiologic environment and prevent polynucleotides degradation by nucleases.

In some embodiments, suspension formulations of NAV may be prepared using combinations of polynucleotides, oil-based solutions and surfactants. Such formulations may be prepared as a two-part system comprising an aqueous phase comprising polynucleotides and an oil-based phase comprising oil and surfactants. Exemplary oils for suspension formulations may include, but are not limited to sesame oil and Miglyol (comprising esters of saturated coconut and palm kernel oil-derived caprylic and capric fatty acids and glycerin or propylene glycol), corn oil, soybean oil, peanut oil, beeswax and/or palm seed oil. Exemplary surfactants may include, but are not limited to Cremophor, polysorbate 20, polysorbate 80, polyethylene glycol, transcutol, Capmul®, labrasol, isopropyl myristate, and/or Span 80. In some embodiments, suspensions may comprise co-solvents including, but not limited to ethanol, glycerol and/or propylene glycol.

Suspensions may be formed by first preparing NAV formulation comprising an aqueous solution of polynucleotide and an oil-based phase comprising one or more surfactants. Suspension formation occurs as a result of mixing the two phases (aqueous and oil-based). In some embodiments, such a suspension may be delivered to an aqueous phase to form an oil-in-water emulsion. In some embodiments, delivery of a suspension to an aqueous phase results in the formation of an oil-in-water emulsion in which the oil-based phase comprising polynucleotides forms droplets that may range in size from nanometer-sized droplets to micrometer-sized droplets.

In some embodiments, specific combinations of oils, surfactants, cosurfactants and/or co-solvents may be utilized to suspend NAVs in the oil phase and/or to form oil-in-water emulsions upon delivery into an aqueous environment.

In some embodiments, suspensions may provide modulation of the release of NAVs into the surrounding environment. In such embodiments, NAV release may be modulated by diffusion from a water immiscible depot followed by resolubilization into a surrounding environment (e.g. an aqueous environment).

In some embodiments, NAVs within a water immiscible depot (e.g. suspended within an oil phase) may result in altered polynucleotides stability (e.g. altered degradation by nucleases).

In some embodiments, NAVs may be formulated such that upon injection, an emulsion forms spontaneously (e.g. when delivered to an aqueous phase). Such particle formation may provide a high surface area to volume ratio for release of polynucleotides from an oil phase to an aqueous phase.

In one embodiment, the NAVs may be formulated in a nanoemulsion such as, but not limited to, the nanoemulsions described in U.S. Pat. No. 8,496,945, the contents of which are herein incorporated by reference in its entirety. The nanoemulsions may comprise nanoparticles described herein. As a non-limiting example, the nanoparticles may comprise a liquid hydrophobic core which may be surrounded or coated with a lipid or surfactant layer. The lipid or surfactant layer may comprise at least one membrane-integrating peptide and may also comprise a targeting ligand (see e.g., U.S. Pat. No. 8,496,945, the contents of which are herein incorporated by reference in its entirety).

Cations and Anions

Formulations of NAVs disclosed herein may include cations or anions. In one embodiment, the formulations include metal cations such as, but not limited to, $Zn^{2+}$, $Ca^{2+}$, $Cu^{2+}$, $Mg^+$ and combinations thereof. As a non-limiting example, formulations may include polymers and a RNAV complexed with a metal cation (See e.g., U.S. Pat.

Nos. 6,265,389 and 6,555,525, each of which is herein incorporated by reference in its entirety).

In some embodiments, cationic nanoparticles comprising combinations of divalent and monovalent cations may be formulated with NAVs. Such nanoparticles may form spontaneously in solution over a give period (e.g. hours, days, etc). Such nanoparticles do not form in the presence of divalent cations alone or in the presence of monovalent cations alone. The delivery of NAVs in cationic nanoparticles or in one or more depot comprising cationic nanoparticles may improve NAV bioavailability by acting as a long-acting depot and/or reducing the rate of degradation by nucleases.

Molded Nanoparticles and Microparticles

The NAVs disclosed herein may be formulated in nanoparticles and/or microparticles. These nanoparticles and/or microparticles may be molded into any size shape and chemistry. As an example, the nanoparticles and/or microparticles may be made using the PRINT® technology by LIQUIDA TECHNOLOGIES® (Morrisville, N.C.) (See e.g., International Pub. No. WO2007024323; the contents of which are herein incorporated by reference in its entirety).

In one embodiment, the molded nanoparticles may comprise a core of the NAVs disclosed herein and a polymer shell. The polymer shell may be any of the polymers described herein and are known in the art. In an additional embodiment, the polymer shell may be used to protect the NAVs in the core.

In one embodiment, the NAVs of the present invention may be formulated in microparticles. The microparticles may contain a core of the NAVs and a cortext of a biocompatible and/or biodegradable polymer. As a non-limiting example, the microparticles which may be used with the present invention may be those described in U.S. Pat. No. 8,460,709, U.S. Patent Publication No. US20130129830 and International Patent Publication No WO2013075068, each of which is herein incorporated by reference in its entirety. As another non-limiting example, the microparticles may be designed to extend the release of the NAVs of the present invention over a desired period of time (see e.g, extended release of a therapeutic protein in U.S. Patent Publication No. US20130129830, herein incorporated by reference in its entirety).

The microparticle for use with the present invention may have a diameter of at least 1 micron to at least 100 microns (e.g., at least 1 micron, at least 5 micron, at least 10 micron, at least 15 micron, at least 20 micron, at least 25 micron, at least 30 micron, at least 35 micron, at least 40 micron, at least 45 micron, at least 50 micron, at least 55 micron, at least 60 micron, at least 65 micron, at least 70 micron, at least 75 micron, at least 80 micron, at least 85 micron, at least 90 micron, at least 95 micron, at least 97 micron, at least 99 micron, and at least 100 micron).

NanoJackets and NanoLiposomes

The NAVs disclosed herein may be formulated in NanoJackets and NanoLiposomes by Keystone Nano (State College, Pa.). NanoJackets are made of compounds that are naturally found in the body including calcium, phosphate and may also include a small amount of silicates. Nanojackets may range in size from 5 to 50 nm and may be used to deliver hydrophilic and hydrophobic compounds such as, but not limited to, NAVs.

NanoLiposomes are made of lipids such as, but not limited to, lipids which naturally occur in the body. NanoLiposomes may range in size from 60-80 nm and may be used to deliver hydrophilic and hydrophobic compounds such as, but not limited to, NAVs. In one aspect, the NAVs disclosed herein are formulated in a NanoLiposome such as, but not limited to, Ceramide NanoLiposomes.

Pseudovirions

In one embodiment, the NAVs disclosed herein may be formulated in Pseudovirions (e.g., pseudo-virions). As a non-limiting example, the pseudovirions may be those developed and/or are described by Aura Biosciences (Cambridge, Mass.). In one aspect, the pseudovirion may be developed to deliver drugs to keratinocytes and basal membranes (See e.g., US Patent Publication Nos. US20130012450, US20130012566, US21030012426 and US20120207840 and International Publication No. WO2013009717, each of which is herein incorporated by reference in its entirety).

In one embodiment, the pseudovirion used for delivering the NAVs of the present invention may be derived from viruses such as, but not limited to, herpes and papillomaviruses (See e.g., US Patent Publication Nos. US Patent Publication Nos. US20130012450, US20130012566, US21030012426 and US20120207840 and International Publication No. WO2013009717, each of which is herein incorporated by reference in its entirety; and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Pseudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety).

The pseudovirion may be a virus-like particle (VLP) prepared by the methods described in US Patent Publication No. US20120015899 and US20130177587 and International Patent Publication No. WO2010047839 WO2013116656, WO2013106525 and WO2013122262, the contents of each of which is herein incorporated by reference in its entirety. In one aspect, the VLP may be, but is not limited to, bacteriophages MS, Qβ3, R17, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, *Cassia* yellow blotch virus, Cowpea chlorotic mottle virus (CCMV), Melandrium yellow fleck virus, and Spring beauty latent virus. In another aspect, the VLP may be derived from the influenza virus as described in US Patent Publication No. US20130177587 or U.S. Pat. No. 8,506,967, the contents of each of which are herein incorporated by reference in its entirety. In yet another aspect, the VLP may comprise a B7-1 and/or B7-2 molecule anchored to a lipid membrane or the exterior of the particle such as described in International Patent Publication No. WO2013116656, the contents of which are herein incorporated by reference in its entirety. In one aspect, the VLP may be derived from norovirus, rotavirus recombinant VP6 protein or double layered VP2/VP6 such as the VLP described in International Patent Publication No. WO2012049366, the contents of which are herein incorporated by reference in its entirety.

The pseudovirion may be a human papilloma virus-like particle such as, but not limited to, those described in International Publication No. WO2010120266 and US Patent Publication No. US20120171290, each of which is herein incorporated by reference in its entirety and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Psedudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety.

In one aspect, the pseudovirions may be virion derived nanoparticles such as, but not limited to, those described in US Patent Publication No. US20130116408 and US20130115247, each of which is herein incorporated by reference in their entirety. As a non-limiting example, the virion derived nanoparticles may be used to deliver NAVs which may be used in the treatment for cancer and/or enhance the immune system's recognition of the tumor. As a non-limiting example, the virion-derived nanoparticle which may selectively deliver an agent to at least one tumor may be the papilloma-derived particles described in International Patent Publication No. WO2013119877, the contents of which are herein incorporated by reference in its entirety. The virion derived nanoparticles may be made by the methods described in US Patent Publication No. US20130116408 and US20130115247 or International Patent Publication No. WO2013119877, each of which is herein incorporated by reference in their entirety.

In one embodiment, the virus-like particle (VLP) may be a self-assembled particle. Non-limiting examples of self-assembled VLPs and methods of making the self-assembled VLPs are described in International Patent Publication No. WO2013122262, the contents of which are herein incorporated by reference in its entirety.

Minicells

In one aspect, the NAVs may be formulated in bacterial minicells. As a non-limiting example, bacterial minicells may be those described in International Publication No. WO2013088250 or US Patent Publication No. US20130177499, the contents of each of which are herein incorporated by reference in its entirety. The bacterial minicells comprising therapeutic agents such as NAVs described herein may be used to deliver the therapeutic agents to brain tumors.

Semi-Solid Compositions

In one embodiment, the NAVs may be formulated with a hydrophobic matrix to form a semi-solid composition. As a non-limiting example, the semi-solid composition or paste-like composition may be made by the methods described in International Patent Publication No WO201307604, herein incorporated by reference in its entirety. The semi-solid composition may be a sustained release formulation as described in International Patent Publication No WO201307604, herein incorporated by reference in its entirety.

In another embodiment, the semi-solid composition may further have a micro-porous membrane or a biodegradable polymer formed around the composition (see e.g., International Patent Publication No WO201307604, herein incorporated by reference in its entirety).

The semi-solid composition using the NAVs of the present invention may have the characteristics of the semi-solid mixture as described in International Patent Publication No WO201307604, herein incorporated by reference in its entirety (e.g., a modulus of elasticity of at least $10^{-4}$ $N \cdot mm^{-2}$, and/or a viscosity of at least 100 mPa·s).

Exosomes

In one embodiment, the NAVs may be formulated in exosomes. The exosomes may be loaded with at least one NAV and delivered to cells, tissues and/or organisms. As a non-limiting example, the NAVs may be loaded in the exosomes described in International Publication No. WO2013084000, herein incorporated by reference in its entirety.

Silk-Based Delivery

In one embodiment, the NAVs may be formulated in a sustained release silk-based delivery system. The silk-based delivery system may be formed by contacting a silk fibroin solution with a therapeutic agent such as, but not limited to, the NAVs described herein and/or known in the art. As a non-limiting example, the sustained release silk-based delivery system which may be used in the present invention and methods of making such system are described in US Patent Publication No. US20130177611, the contents of which are herein incorporated by reference in its entirety.

Microparticles

In one embodiment, formulations comprising NAVs may comprise microparticles. The microparticles may comprise a polymer described herein and/or known in the art such as, but not limited to, poly($\alpha$-hydroxy acid), a polyhydroxy butyric acid, a polycaprolactone, a polyorthoester and a polyanhydride. The microparticle may have adsorbent surfaces to adsorb biologically active molecules such as NAVs. As a non-limiting example microparticles for use with the present invention and methods of making microparticles are described in US Patent Publication No. US2013195923 and US20130195898 and U.S. Pat. Nos. 8,309,139 and 8,206,749, the contents of each of which are herein incorporated by reference in its entirety.

In another embodiment, the formulation may be a microemulsion comprising microparticles and NAVs. As a non-limiting example, microemulsions comprising microparticles are described in US Patent Publication No. US2013195923 and US20130195898 and U.S. Pat. Nos. 8,309,139 and 8,206,749, the contents of each of which are herein incorporated by reference in its entirety.

Amino Acid Lipids

In one embodiment, the NAVs may be formulated in amino acid lipids. Amino acid lipids are lipophilic compounds comprising an amino acid residue and one or more lipophilic tails. Non-limiting examples of amino acid lipids and methods of making amino acid lipids are described in U.S. Pat. No. 8,501,824, the contents of which are herein incorporated by reference in its entirety.

In one embodiment, the amino acid lipids have a hydrophilic portion and a lipophilic portion. The hydrophilic portion may be an amino acid residue and a lipophilic portion may comprise at least one lipophilic tail.

In one embodiment, the amino acid lipid formulations may be used to deliver the NAVs to a subject.

In another embodiment, the amino acid lipid formulations may deliver a NAV in releasable form which comprises an amino acid lipid that binds and releases the NAV. As a non-limiting example, the release of the NAVs may be provided by an acid-labile linker such as, but not limited to, those described in U.S. Pat. Nos. 7,098,032, 6,897,196, 6,426,086, 7,138,382, 5,563,250, and 5,505,931, the contents of each of which are herein incorporated by reference in its entirety.

Microvesicles

In one embodiment, NAVs may be formulated in microvesicles. Non-limiting examples of microvesicles include those described in US Patent Publication No. US20130209544, the contents of which are herein incorporated by reference in its entirety.

In one embodiment, the microvesicle is an ARRDC1-mediated microvesicles (ARMMs). Non-limiting examples of ARMMs and methods of making ARMMs are described in International Patent Publication No. WO2013119602, the contents of which are herein incorporated by reference in its entirety.

Interpolyelectrolyte Complexes

In one embodiment, the NAVs may be formulated in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, the contents of which is herein incorporated by reference in its entirety.

Crystalline Polymeric Systems

In one embodiment, the NAVs may be formulated in crystalline polymeric systems. Crystalline polymeric systems are polymers with crystalline moieties and/or terminal units comprising crystalline moieties. Non-limiting examples of polymers with crystalline moieties and/or terminal units comprising crystalline moieties termed "CYC polymers," crystalline polymer systems and methods of making such polymers and systems are described in U.S. Pat. No. 8,524,259, the contents of which are herein incorporated by reference in its entirety.

Excipients

NAV pharmaceutical formulations may additionally comprise a pharmaceutically acceptable excipient, which, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants, flavoring agents, stabilizers, antioxidants, osmolality adjusting agents, pH adjusting agents and the like, as suited to the particular dosage form desired. Various excipients for formulating pharmaceutical compositions and techniques for preparing the composition are known in the art (see *Remington: The Science and Practice of Pharmacy*, 21$^{st}$ Edition, A. R. Gennaro (Lippincott, Williams & Wilkins, Baltimore, Md., 2006; incorporated herein by reference in its entirety). The use of a conventional excipient medium may be contemplated within the scope of the present disclosure, except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions. The composition may also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate [SPAN®60], sorbitan tristearate [SPAN®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); amino acids (e.g., glycine); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

In some embodiments, the pH of the NAV solutions are maintained between pH 5 and pH 8 to improve stability. Exemplary buffers to control pH may include, but are not limited to sodium phosphate, sodium citrate, sodium succinate, histidine (or histidine-HCl), sodium carbonate, and/or sodium malate. In another embodiment, the exemplary buffers listed above may be used with additional monovalent counterions (including, but not limited to potassium). Divalent cations may also be used as buffer counterions; however, these are not preferred due to complex formation and/or mRNA degradation.

Exemplary buffering agents may also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Cryoprotectants

In some embodiments, NAV formulations may comprise cyroprotectants. As used herein, there term "cryoprotectant" refers to one or more agent that when combined with a given substance, helps to reduce or eliminate damage to that substance that occurs upon freezing. In some embodiments, cryoprotectants are combined with NAVs in order to stabilize them during freezing. Frozen storage of NAVs between −20° C. and −80° C. may be advantageous for long term (e.g. 36 months) stability of polynucleotide. In some embodiments, cryoprotectants are included in NAV formulations to stabilize polynucleotide through freeze/thaw cycles and under frozen storage conditions. Cryoprotectants of the present invention may include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

In some embodiments, NAV formulations may comprise bulking agents. As used herein, the term "bulking agent" refers to one or more agents included in formulations to impart a desired consistency to the formulation and/or stabilization of formulation components. In some embodiments, bulking agents are included in lyophilized NAV formulations to yield a "pharmaceutically elegant" cake, stabilizing the lyophilized NAVs during long term (e.g. 36 month) storage. Bulking agents of the present invention may include, but are not limited to sucrose, trehalose, mannitol, glycine, lactose and/or raffinose. In some embodiments, combinations of cryoprotectants and bulking agents (for example, sucrose/glycine or trehalose/mannitol) may be included to both stabilize NAVs during freezing and provide a bulking agent for lyophilization.

Non-limiting examples of formulations and methods for formulating the NAVs of the present invention are also provided in International Publication No WO2013090648 filed Dec. 14, 2012, the contents of which are incorporated herein by reference in their entirety.

Inactive Ingredients

In some embodiments, NAV formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present invention may be approved by the US Food and Drug Administration (FDA). A non-exhaustive list of inactive ingredients and the routes of administration the inactive ingredients may be formulated in are described in Table 26. In Table 26, "AN" means anesthetic, "CNBLK" means cervical nerve block, "NBLK" means nerve block, "IV" means intravenous, "IM" means intramuscular and "SC" means subcutaneous

TABLE 26

| Inactive Ingredients | |
|---|---|
| Inactive Ingredient | Route of Administration |
| Alpha-Terpineol | Topical |
| Alpha-Tocopherol | Intravenous; Topical |
| Alpha-Tocopherol Acetate, Dl- | Topical |
| Alpha-Tocopherol, Dl- | Intravenous; Topical |
| 1,2,6-Hexanetriol | Topical |
| 1,2-Dimyristoyl-Sn-Glycero-3-(Phospho-S-(1-Glycerol)) | Intravenous; Infusion (IV) |
| 1,2-Dimyristoyl-Sn-Glycero-3-Phosphocholine | Intravenous; Infusion (IV) |
| 1,2-Dioleoyl-Sn-Glycero-3-Phosphocholine | Epidural |
| 1,2-Dipalmitoyl-Sn-Glycero-3-(Phospho-Rac-(1-Glycerol)) | Epidural |
| 1,2-Distearoyl-Sn-Glycero-3-(Phospho-Rac-(1-Glycerol)) | Intravenous |

TABLE 26-continued

Inactive Ingredients

| Inactive Ingredient | Route of Administration |
| --- | --- |
| 1,2-Distearoyl-Sn-Glycero-3-Phosphocholine | Intravenous |
| 1-O-Tolylbiguanide | Topical |
| 2-Ethyl-1,6-Hexanediol | Topical |
| Acetic Acid | Infiltration; Auricular (Otic); Extracorporeal; Intramuscular; Intravenous; Subcutaneous; Intra-articualr; Intralesional; Intramuscular; Intrasynovial; Intratracheal; Intravenous; Irrigation; Infusion (IV); Nasal; Nerve block; Ophthalmic; Photopheresis; Soft Tissue; Submucosal; Topical |
| Acetic Acid, Glacial | Intravenous; Infusion (IV); Subcutaneous |
| Acetic Anhydride | Intravenous |
| Acetone | Implantation; Topical |
| Acetone Sodium Bisulfite | Intrathecal (AN, CNBLK); Infiltration (AN); Dental; Inhalation; Nerve Block |
| Acetylated Lanolin Alcohols | Topical |
| Acetylated Monoglycerides | Intravenous |
| Acetylcysteine | Inhalation |
| Acetyltryptophan, DL- | Intravenous |
| Acrylates Copolymer | Topical; Transdermal |
| Acrylic Acid-Isooctyl Acrylate Copolymer | Transdermal |
| Acrylic Adhesive 788 | Transdermal |
| Activated Charcoal | Intramuscular; Intravenous; Irrigation; Infusion (IV) |
| Adcote 72A103 | Transdermal |
| Adhesive Tape | Topical |
| Adipic Acid | Intramuscular; Vaginal |
| Aerotex Resin 3730 | Transdermal |
| Alanine | Infusion (IV) |
| Albumin Aggregated | Intravenous |
| Albumin Colloidal | Intravenous |
| Albumin Human | Intravenous; Infusion (IV); Subcutaneous |
| Alcohol | Dental; Intramuscular; Intravenous; Subcutaneous; Inhalation; Intravascular; Infusion (IV); Ophthalmic; Rectal; Respiratory (Inhalation); Topical; Transdermal |
| Alcohol, Dehydrated | Dental; Extracorporeal; Intramuscular; Intravenous; Subcutaneous; Inhalation; Intracavitary; Intravascular; Intravesical; Nasal, Ophthalmic; Photopheresis, Rectal; Respiratory (Inhalation); Sublingual; Topical; Transdermal |
| Alcohol, Denatured | Denatal; Intravenous; Topical; Vaginal |
| Alcohol, Diluted | Intramuscular; Intravenous; Topical |
| Alfadex | Intracavitary |
| Alginic Acid | Ophthalmic |
| Alkyl Ammonium Sulfonic Acid Betaine | Topical |
| Alkyl Aryl Sodium Sulfonate | Topical |
| Allantoin | Topical; Vaginal |
| Allyl .Alpha.-Ionone | Nasal |
| Almond Oil | Topical |
| Aluminum Acetate | Auricular (Otic); Topical |
| Aluminum Chlorhydroxy Allantoinate | Topical |
| Aluminum Hydroxide | Topical |
| Aluminum Hydroxide-Sucrose, Hydrated | Topical |
| Aluminum Hydroxide Gel | Topical |
| Aluminum Hydroxide Gel F 500 | Topical |
| Aluminum Hydroxide Gel F 5000 | Topical |
| Aluminum Monostearate | Topical |
| Aluminum Oxide | Topical |
| Aluminum Polyester | Transdermal |
| Aluminum Silicate | Topical |
| Aluminum Starch Octenylsuccinate | Topical |
| Aluminum Stearate | Topical |
| Aluminum Subacetate | Rectal |
| Aluminum Sulfate Anhydrous | Auricular (Otic); Topical |
| Amerchol C | Topical |
| Amerchol-Cab | Ophthalmic; Topical |
| Aminomethylpropanol | Topical |
| Ammonia | Inhalation |
| Ammonia Solution | Topical |
| Ammonia Solution, Strong | Topical |
| Ammonium Acetate | Intramuscular; Intravenous; Infusion (IV) |
| Ammonium Hydroxide | Intravenous; Ophthalmic; Subcutaneous; Topical |
| Ammonium Lauryl Sulfate | Topical |
| Ammonium Nonoxynol-4 Sulfate | Topical |
| Ammonium Salt Of C-12-C-15 Linear Primary Alcohol Ethoxylate | Topical |
| Ammonium Sulfate | Intravenous |

TABLE 26-continued

| Inactive Ingredients | |
|---|---|
| Inactive Ingredient | Route of Administration |
| Ammonyx | Topical |
| Amphoteric-2 | Topical |
| Amphoteric-9 | Topical |
| Anethole | Dental |
| Anhydrous Citric Acid | Intravenous; Infusion (IV); Rectal; Topical |
| Anhydrous Dextrose | Intramuscular; Intravenous; Subcutaneous; Infusion (IV); Nasal; Spinal |
| Anhydrous Lactose | Intramuscular; Intravenous; Intracavitary; Intravenous; Infusion (IV); Vaginal |
| Anhydrous Trisodium Citrate | Intramuscular; Intravenous; Intra-arterial; Intra-articular; Intrabursal; Infusion (IV); Nasal; Ophthalmic; Soft Tissue; Topical |
| Aniseed Oil | Rectal |
| Anoxid Sbn | Topical |
| Antifoam | Topical |
| Antipyrine | Ophthalmic |
| Apaflurane | Respiratory (Inhalation) |
| Apricot Kernel Oil Peg-6 Esters | Topical; Vaginal |
| Aquaphor | Topical |
| Arginine | Intramuscular; Intravenous; Infusion (IV) |
| Arlacel | Topical |
| Ascorbic Acid | Infiltration (AN); Caudal Block; Epidural; Intramuscular; Intravenous; Inhalation; Infusion (IV); Nerve Block; Rectal; Subctaneous; Topical |
| Ascorbyl Palmitate | Rectal; Topical |
| Aspartic Acid | Infusion (IV) |
| Balsam Peru | Rectal |
| Barium Sulfate | Intrauterine; Vaginal |
| Beeswax | Topical; Vaginal |
| Beeswax, Synthetic | Topical |
| Beheneth-10 | Topical |
| Bentonite | Topical; Transdermal; Vaginal |
| Benzalkonium Chloride | Auricular (Otic); Inhalation; Intra-Articular; Intrabursal; Intradermal; Intralesional; Intramuscular; Intraocular; Nasal; Ophthalmic; Respiratory (Inhalation); Topical |
| Benzenesulfonic Acid | Intravenous; Infusion (IV) |
| Benzethonium Chloride | Auricular (Otic); Intramuscular; Intravenous; Infusion (IV); Nasal; Ophthalmic |
| Benzododecinium Bromide | Ophthalmic |
| Benzoic Acid | Intramuscular; Intravenous; Irrigation; Infusion (IV); Rectal; Topical; Vaginal |
| Benzyl Alcohol | Infiltration (AN); Auricular (Otic); Dental; Epidural; Extracorporeal; Interstitial; Intra-Arterial; Intra-Articular; Intrabursal; Intracavitary; Intradermal; Intralesional; Intramuscular; Intraperitoneal; Intrapleural; Intrasynovial; Intrathecal; Intratracheal; Intratumor; Intravenous; Infusion(IV); Nasal; Nerve Block; Rectal; Soft Tissue; Subconjunctival; Subcutaneous; Topical; Ureteral; Vaginal |
| Benzyl Benzoate | Intramuscular |
| Benzyl Chloride | Intravenous |
| Betadex | Topical |
| Bibapcitide | Intravenous |
| Bismuth Subgallate | Rectal |
| Boric Acid | Auricular (Otic); Intravenous; Ophthalmic; Topical |
| Brocrinat | Infusion (IV) |
| Butane | Topical |
| Butyl Alcohol | Topical |
| Butyl Ester Of Vinyl Methyl Ether/Maleic Anhydride Copolymer (125000 Mw) | Topical |
| Butyl Stearate | Topical |
| Butylated Hydroxyanisole | Intramuscular; Infusion (IV); Nasal; Rectal; Topical; Vaginal |
| Butylated Hydroxytoluene | Intramuscular; Intravenous; Infusion (IV); Nasal; Rectal; Topical; Transdermal; Vaginal |
| Butylene Glycol | Topical; Transdermal |
| Butylparaben | Intramuscular; Rectal; Topical |
| Butyric Acid | Transdermal |
| C20-40 Pareth-24 | Topical |

TABLE 26-continued

| Inactive Ingredients | |
|---|---|
| Inactive Ingredient | Route of Administration |
| Caffeine | Nasal; Ophthalmic |
| Calcium | Intramuscular |
| Calcium Carbonate | Auricular (Otic); Respiratory (Inhalation) |
| Calcium Chloride | Infiltration (AN); Caudal Block; Epidural; Intramuscular; Intravenous; Intraocular; Intraperitoneal; Intravascular; Intravitreal; Nerve Block; Ophthalmic; Subctaneous; Topical |
| Calcium Gluceptate | Intravenous |
| Calcium Hydroxide | Intravenous; Subcutaneous; Topical |
| Calcium Lactate | Vaginal |
| Calcobutrol | Intravenous |
| Caldiamide Sodium | Intravenous |
| Caloxetate Trisodium | Intravenous |
| Calteridol Calcium | Intravenous |
| Canada Balsam | Topical |
| Caprylic/Capric Triglyceride | Topical; Transdermal |
| Caprylic/Capric/Stearic Triglyceride | Topical |
| Captan | Topical |
| Captisol | Intravenous |
| Caramel | Rectal; Topical |
| Carbomer 1342 | Ophthalmic; Topical; Transdermal |
| Carbomer 1382 | Topical |
| Carbomer 934 | Rectal; Topical; Vaginal |
| Carbomer 934p | Ophthalmic; Rectal; Topical; Vaginal |
| Carbomer 940 | Ophthalmic; Topical; Transdermal |
| Carbomer 941 | Topical |
| Carbomer 980 | Topical; Transdermal |
| Carbomer 981 | Topical |
| Carbomer Homopolymer Type B (Allyl Pentaerythritol Crosslinked) | Ophthalmic; Topical |
| Carbomer Homopolymer Type C (Allyl Pentaerythritol Crosslinked) | Topical |
| Carbon Dioxide | Infiltration (AN); Intramuscular (IM); Infusion (IV); Inhalation; Intra-arterial; Intracardiac; Intrathecal; Intravascular; Intravenous |
| Carboxy Vinyl Copolymer | Topical |
| Carboxymethylcellulose | Intra-articular; Intrabursal; Intralesional; Intramuscular; Soft tissue; Topical |
| Carboxymethylcellulose Sodium | Dental; Intra-articular; Intrabursal; Intradermal; Intramuscular; Intrasynovial; Intratracheal; Nasal; Ophthalmic; Soft tissue; Subcutaneous; Topical |
| Carboxypolymethylene | Rectal; Topical |
| Carrageenan | Dental; Topical; Transdermal |
| Carrageenan Salt | Topical |
| Castor Oil | Intramuscular; Ophthalmic; Topical |
| Cedar Leaf Oil | Topical |
| Cellulose | Topical |
| Cellulose, Microcrystalline | Intra-articular; Intramuscular; Intravenous; Intravitreal; Nasal; Vaginal |
| Cerasynt-Se | Rectal; Topical |
| Ceresin | Topical |
| Ceteareth-12 | Topical |
| Ceteareth-15 | Topical |
| Ceteareth-30 | Topical |
| Cetearyl Alcohol/Ceteareth-20 | Topical |
| Cetearyl Ethylhexanoate | Topical |
| Ceteth-10 | Topical |
| Ceteth-2 | Topical |
| Ceteth-20 | Topical; Vaginal |
| Ceteth-23 | Topical |
| Cetostearyl Alcohol | Topical; Vaginal |
| Cetrimonium Chloride | Topical |
| Cetyl Alcohol | Auricular (Otic); Ophthalmic; Rectal; Topical; Vaginal |
| Cetyl Esters Wax | Topical; Vaginal |
| Cetyl Palmitate | Topical; Vaginal |
| Cetylpyridinium Chloride | Inhalation; Iontophoresis; Transdermal |
| Chlorobutanol | Infiltration (AN); Auricular (Otic); Intramuscular (IM); Infusion (IV); Subcutaneous (SC); Inhalation; Intravenous; Nasal; Nerve Block; Ophthalmic; Topical |

TABLE 26-continued

Inactive Ingredients

| Inactive Ingredient | Route of Administration |
| --- | --- |
| Chlorobutanol Hemihydrate | Intramuscular; Intravenous |
| Chlorobutanol, Anhydrous | Intramuscular; Intravenous; Ophthalmic |
| Chlorocresol | Topical |
| Chloroxylenol | Auricular (Otic); Topical |
| Cholesterol | Epidural; Infiltration; Intravecous; Ophthalmic; Topical; Vaginal |
| Choleth | Vaginal |
| Choleth-24 | Topical |
| Citrate | Intravenous |
| Citric Acid | Intrathecal (AN, CNBLK); Infiltration (AN); Auricular (Otic); Caudal Block; Epidural; Intramuscular (IM); Infusion (IV); Subcutaneous (SC); Infiltration; Inhalation; Intra-amniotic; Intra-arterial; Intra-articular; Intrabursal; Intracardiac; Intralesional; Iintrapleural; Intrasynovial; Intrathecal; Intravascular; Intravenous; Iontophoresis; Nasal; Nerve Block; Ophthalmic; Peridural; Soft tissue; Topical; Transdermal; Vaginal |
| Citric Acid Monohydrate | Infiltration (AN); Intramuscular (IM); Infusion (IV); Subcutaneous (SC); Intracardiac; Intraocular; Intravenous; Nasal; Nerve Block; Ophthalmic; Topical; Vaginal |
| Citric Acid, Hydrous | Intramuscular (IM); Infusion (IV); Subcutaneous (SC); Intravenous |
| Cocamide Ether Sulfate | Topical |
| Cocamine Oxide | Topical |
| Coco Betaine | Topical |
| Coco Diethanolamide | Topical |
| Coco Monoethanolamide | Topical |
| Cocoa Butter | Rectal; Topical |
| Coco-Glycerides | Topical |
| Coconut Oil | Topical |
| Coconut Oil, Hydrogenated | Rectal |
| Coconut Oil/Palm Kernel Oil Glycerides, Hydrogenated | Rectal; Vaginal |
| Cocoyl Caprylocaprate | Topical |
| Cola Nitida Seed Extract | Rectal |
| Collagen | Topical |
| Coloring Suspension | Topical |
| Corn Oil | Intramuscular |
| Cottonseed Oil | Intramuscular |
| Cream Base | Topical |
| Creatine | Intra-articular; Intralesional; Intramuscular |
| Creatinine | Auricular (Otic); Intramuscular (IM); Infusion (IV); Subcutaneous (SC); Intra-articular; Intrabursal; Intradermal; Intralesional; Intrasynovial; Ophthalmic; Soft tissue; Topical |
| Cresol | Subcutaneous |
| Croscarmellose Sodium | Intramuscular |
| Crospovidone | Implantation; Intra-articluar; Intramuscular; Intrauterine; Topical; Transdermal; Vagiinal |
| Cupric Sulfate | Auricular (Otic) |
| Cupric Sulfate Anhydrous | Auricular (Otic) |
| Cyclomethicone | Topical |
| Cyclomethicone/Dimethicone Copolyol | Topical |
| Cysteine | Intramuscular (IM); Subcutaneous (SC); Intravenous; Infusion (IV) |
| Cysteine Hydrochloride | Intravenous; Infusion (IV) |
| Cysteine Hydrochloride Anhydrous | Intradiscal |
| Cysteine, Dl- | Intradiscal |
| D&C Red No. 28 | Topical |
| D&C Red No. 33 | Topical |
| D&C Red No. 36 | Topical |
| D&C Red No. 39 | Topical |
| D&C Yellow No. 10 | Dental; Inhalation; Rectal; Topical |
| Dalfampridine | Intravenous |
| Daubert 1-5 Pestr (Matte) 164z | Transdermal |
| Decyl Methyl Sulfoxide | Topical |
| Dehydag Wax Sx | Topical |
| Dehydroacetic Acid | Topical |
| Dehymuls E | Topical |
| Denatonium Benzoate | Topical |
| Deoxycholic Acid | Infusion (IV) |
| Dextran | Intravenous |
| Dextran 40 | Intravenous |
| Dextrin | Topical |

TABLE 26-continued

Inactive Ingredients

| Inactive Ingredient | Route of Administration |
| --- | --- |
| Dextrose | Intramuscular (IM); Infusion (IV); Subcutaneous (SC); Interstitial; Intracavitary; Intraperitoneal; Intrapleural; Intraspinal; Intravenous; Nasal; Spinal |
| Dextrose Monohydrate | Intravenous |
| Dextrose Solution | Intravenous; Infusion (IV) |
| Diatrizoic Acid | Intra-arterial; Intra-articular; Intracardiac; Intradiscal; Intramuscular; Intrauterine; Intravascular; Intravenous; Infusion (IV); Periarticular; Subcutaneous; Ureteral; Urethral |
| Diazolidinyl Urea | Topical |
| Dichlorobenzyl Alcohol | Topical |
| Dichlorodifluoromethane | Inhalation; Intrapleural; Nasal; Rectal; Topical |
| Dichlorotetrafluoroethane | Inhalation; Nasal; Rectal; Topical |
| Diethanolamine | Infusion (IV); Ophthalmic; Topical |
| Diethyl Pyrocarbonate | Inflitration |
| Diethyl Sebacate | Topical |
| Diethylene Glycol Monoethyl Ether | Topical; Transdermal |
| Diethylhexyl Phthalate | Ophthalmic; Transdermal |
| Dihydroxyaluminum Aminoacetate | Topical |
| Diisopropanolamine | Topical |
| Diisopropyl Adipate | Topical |
| Diisopropyl Dilinoleate | Topical |
| Dimethicone 350 | Topical |
| Dimethicone Copolyol | Topical; Transermal |
| Dimethicone Mdx4-4210 | Transdermal |
| Dimethicone Medical Fluid 360 | Dental; Intravenous; Topical; Transdermal |
| Dimethyl Isosorbide | Topical |
| Dimethyl Sulfoxide | Infusion (IV); Subcutanous; Topical |
| Dimethylaminoethyl Methacrylate-Butyl Methacrylate-Methyl Methacrylate Copolymer | Transdermal |
| Dimethyldioctadecylammonium Bentonite | Rectal |
| Dimethylsiloxane/Methylvinylsiloxane Copolymer | Implantation; Intrauterine |
| Dinoseb Ammonium Salt | Topical |
| Dipalmitoylphosphatidylglycerol, Dl- | Inflitration |
| Dipropylene Glycol | Transdermal |
| Disodium Cocoamphodiacetate | Topical |
| Disodium Laureth Sulfosuccinate | Topical |
| Disodium Lauryl Sulfosuccinate | Topical |
| Disodium Sulfosalicylate | Topical |
| Disofenin | Topical |
| Divinylbenzene Styrene Copolymer | Ophthalmic |
| Dmdm Hydantoin | Topical |
| Docosanol | Topical |
| Docusate Sodium | Intramuscular; Topical |
| Duro-Tak 280-2516 | Transdermal |
| Duro-Tak 387-2516 | Transdermal |
| Duro-Tak 80-1196 | Transdermal |
| Duro-Tak 87-2070 | Transdermal |
| Duro-Tak 87-2194 | Transdermal |
| Duro-Tak 87-2287 | Percutaneous; Transdermal |
| Duro-Tak 87-2296 | Transdermal |
| Duro-Tak 87-2888 | Transdermal |
| Duro-Tak 87-2979 | Transdermal |
| Edetate Calcium Disodium | Infiltration (AN); Caudal Block; Epidural; Intramuscular (IM); Infusion (IV); Intra-articular; Intra-arterial; Intracardiac; Intradiscal; Intraperitoneal; Intrathecal; Intrauterine; Intravascular; Intravenous; Intravesical; Nerve Block; Periarticular; Rectal; Subcutaneous; Ureteral; Urethral |
| Edetate Disodium | Infiltration (AN), Auricular (Otic); Caudal Block; Epidural; Intramuscular (IM); Infusion (IV); Subcutaneous (SC); Inhalation; Intra-arterial; Intra-articular; Intrabursal; Intracardiac; Intradermal; Intradiscal; Intralesional; Intrasynovial; Intrauterine; Intravascular; Intravenous; Iontophoresis; Nasal; Nerve Block; Ophthalmic; Rectal; Respiratory (Inhalation); Soft tissue; Topical; Transdermal; Ureteral; Urethral; Vaginal |
| Edetate Disodium Anhydrous | Intra-amniotic; Intramuscular; Intravenous; Infusion (IV); Ophthalmic |
| Edetate Sodium | Intramuscular (IM); Infusion (IV); Subcutaneous (SC); Inhalation; Ophthalmic; Topical |
| Edetic Acid | Auricular (Otic); Rectal; Submucosal; Topical |

TABLE 26-continued

| Inactive Ingredients | |
|---|---|
| Inactive Ingredient | Route of Administration |
| Egg Phospholipids | Intravenous; Infusion (IV) |
| Entsufon | Topical |
| Entsufon Sodium | Topical |
| Epilactose | Rectal |
| Epitetracycline Hydrochloride | Topical |
| Essence Bouquet 9200 | Topical |
| Ethanolamine Hydrochloride | Intravenous |
| Ethyl Acetate | Intramuscular; Topical; Transdermal |
| Ethyl Oleate | Transdermal |
| Ethylcelluloses | Topical; Transdermal; Vaginal |
| Ethylene Glycol | Topical |
| Ethylene Vinyl Acetate Copolymer | Implantation; Intrauerine; Ophthalmic; Periodontal; Subcutaneous; Transdermal |
| Ethylenediamine | Intravenous; Infusion (IV); Rectal; Topical |
| Ethylenediamine Dihydrochloride | Topical |
| Ethylene-Propylene Copolymer | Transdermal |
| Ethylene-Vinyl Acetate Copolymer (28% Vinyl Acetate) | Vaginal |
| Ethylene-Vinyl Acetate Copolymer (9% Vinylacetate) | Vaginal |
| Ethylhexyl Hydroxystearate | Topical |
| Ethylparaben | Topical |
| Eucalyptol | Dental |
| Exametazime | Intravenous |
| Fat, Edible | Rectal |
| Fat, Hard | Rectal |
| Fatty Acid Esters | Transdermal |
| Fatty Acid Pentaerythriol Ester | Topical |
| Fatty Acids | Topical |
| Fatty Alcohol Citrate | Topical |
| Fatty Alcohols | Vaginal |
| Fd&C Blue No. 1 | Dental; Rectal; Topical |
| Fd&C Green No. 3 | Dental; Rectal |
| Fd&C Red No. 4 | Topical |
| Fd&C Red No. 40 | Topical |
| Fd&C Yellow No. 10 (Delisted) | Topical |
| Fd&C Yellow No. 5 | Topical; Vaginal |
| Fd&C Yellow No. 6 | Inhalation; Rectal; Topical |
| Ferric Chloride | Intravenous |
| Ferric Oxide | Topical |
| Flavor 89-186 | Dental |
| Flavor 89-259 | Dental |
| Flavor Df-119 | Dental |
| Flavor Df-1530 | Dental |
| Flavor Enhancer | Dental |
| Flavor Fig 827118 | Rectal |
| Flavor Raspberry Pfc-8407 | Rectal |
| Flavor Rhodia Pharmaceutical No. Rf 451 | Topical |
| Fluorochlorohydrocarbons | Inhalation |
| Formaldehyde | Topical |
| Formaldehyde Solution | Topical |
| Fractionated Coconut Oil | Topical |
| Fragrance 3949-5 | Topical |
| Fragrance 520a | Topical |
| Fragrance 6.007 | Topical |
| Fragrance 91-122 | Topical |
| Fragrance 9128-Y | Topical |
| Fragrance 93498g | Topical |
| Fragrance Balsam Pine No. 5124 | Topical |
| Fragrance Bouquet 10328 | Topical |
| Fragrance Chemoderm 6401-B | Topical |
| Fragrance Chemoderm 6411 | Topical |
| Fragrance Cream No. 73457 | Topical |
| Fragrance Cs-28197 | Topical |
| Fragrance Felton 066m | Topical |
| Fragrance Firmenich 47373 | Topical |
| Fragrance Givaudan Ess 9090/1c | Topical |
| Fragrance H-6540 | Topical |
| Fragrance Herbal 10396 | Topical |
| Fragrance Nj-1085 | Topical |
| Fragrance P O Fl-147 | Topical |
| Fragrance Pa 52805 | Topical |
| Fragrance Pera Derm D | Topical |
| Fragrance Rbd-9819 | Topical |
| Fragrance Shaw Mudge U-7776 | Topical |
| Fragrance Tf 044078 | Topical |

TABLE 26-continued

Inactive Ingredients

| Inactive Ingredient | Route of Administration |
| --- | --- |
| Fragrance Ungerer Honeysuckle K 2771 | Topical |
| Fragrance Ungerer N5195 | Topical |
| Fructose | Infusion (IV); Rectal |
| Gadolinium Oxide | Intravenous |
| Galactose | Rectal |
| Gamma Cyclodextrin | Intravenous |
| Gelatin | Dental; Intramuscular (IM); Infusion (IV); Subcutaneous (SC); Intravenous; Respiratory (Inhalation); Topical; Vaginal |
| Gelatin, Crosslinked | Dental |
| Gelfoam Sponge | N/A |
| Gellan Gum (Low Acyl) | Ophthalmic |
| Gelva 737 | Transdermal |
| Gentisic Acid | Intravenous |
| Gentisic Acid Ethanolamide | Infusion (IV) |
| Gluceptate Sodium | Intravenous |
| Gluceptate Sodium Dihydrate | Intravenous |
| Gluconolactone | Intramuscular (IM); Infusion (IV); Intravesou; Topical |
| Glucuronic Acid | Intravenous |
| Glutamic Acid, Dl- | Vaginal |
| Glutathione | Intramuscular |
| Glycerin | Auricular (Otic); Dental; Intramuscular; Infusion (IV); Subcutaneous (SC); Inhalation; Intradermal; Intravenous; Iontophoresis; Nasal; Ophthalmic; Perfusion; Biliary; Rectal; Topical; Transdermal; Vaginal |
| Glycerol Ester Of Hydrogenated Rosin | Nasal |
| Glyceryl Citrate | Topical |
| Glyceryl Isostearate | Topical; Vaginal |
| Glyceryl Laurate | Transdermal |
| Glyceryl Monostearate | Topical; Vaginal |
| Glyceryl Oleate | Topical; Transdermal |
| Glyceryl Oleate/Propylene Glycol | Topical |
| Glyceryl Palmitate | Rectal; Topical |
| Glyceryl Ricinoleate | Topical |
| Glyceryl Stearate | Auricular (Otic); Dental; Ophthalmic; Rectal; Topical; Vaginal |
| Glyceryl Stearate-Laureth-23 | Topical |
| Glyceryl Stearate/Peg Stearate | Rectal |
| Glyceryl Stearate/Peg-100 Stearate | Topical |
| Glyceryl Stearate/Peg-40 Stearate | Rectal |
| Glyceryl Stearate-Stearamidoethyl Diethylamine | Topical |
| Glyceryl Trioleate | Epidural |
| Glycine | Intramuscular (IM); Infusion (IV); Subcutaneous (SC); Intravenous; Rectal; Respiratory (Inhalation) |
| Glycine Hydrochloride | Subcutaneous |
| Glycol Distearate | Topical |
| Glycol Stearate | Topical |
| Guanidine Hydrochloride | Intravenous |
| Guar Gum | Topical; Vaginal |
| Hair Conditioner (18n195-1m) | Topical |
| Heptane | Transdermal |
| Hetastarch | Intravenous |
| Hexylene Glycol | Topical |
| High Density Polyethylene | Dental; Intrauterine; Ophthalmic; Topical; Transdermal; Vaginal |
| Histidine | Intravenous; Infusion (IV); Subcutaneous |
| Human Albumin Microspheres | Intravenous |
| Hyaluronate Sodium | Intra-articular; Intramuscular; Intravitreal; Topical |
| Hydrocarbon | Rectal |
| Hydrocarbon Gel, Plasticized | Dental; Ophthalmic; Topical |
| Hydrochloric Acid | Intrathecal (AN, CNBLK); Inflitration (AN); Sympathetic (AN, NBLK); Auricular (Otic); Caudal Block; Dental; Diagnostic; Epidural; Extracorporeal; Intramuscular (IM); Infusion (IV); Subcutaneous (SC); Inflitration; Inhalationi; Interstitial; Intra-amniotic; Intra-arterial; Intra-articular; Intrabursal; Intracardiac; Intracaudal; Intracavitary; Intradermal; Intralesional; Intraocular; Intraperitoneal; Intrapleural; Intraspinal; Intrasynovial; Intrathecal; Intratracheal; Intratumor; Intravascular; Intravenous; Intravesical; Intravitreal; Iontophoresis; Irrigation; Nasal; Nerve Block, Ophthalmic; Parenteral; Perfusion, Cardiac; Peridural; Perineural; |

TABLE 26-continued

Inactive Ingredients

| Inactive Ingredient | Route of Administration |
|---|---|
| | Periodontal; Pectal; Respiratory (Inhalation); Retrobulbar; Soft tissue; Spinal; Subarachnoid; Subconjunctival; Subcutaneous; Topical; Transdermal; Ureteral; Urethral |
| Hydrochloric Acid, Diluted | Infiltration (AN); Intramuscular (IM); Infusion (IV); Subcutaneous (SC); Inhalation; Intra-arterial; Intravascular; Intravenous; Nerve Block; Ophthalmic; Topical |
| Hydrocortisone | Auricular (Otic) |
| Hydrogel Polymer | Vaginal |
| Hydrogen Peroxide | Topical |
| Hydrogenated Castor Oil | Topical |
| Hydrogenated Palm Oil | Rectal; Vaginal |
| Hydrogenated Palm/Palm Kernel Oil Peg-6 Esters | Topical |
| Hydrogenated Polybutene 635-690 | Transdermal |
| Hydroxide Ion | Intramuscular; Infusion (IV) |
| Hydroxyethyl Cellulose | Auricular (Otic); Ophthalmic; Topical; Transdermal |
| Hydroxyethylpiperazine Ethane Sulfonic Acid | Intravenous |
| Hydroxymethyl Cellulose | Topical |
| Hydroxyoctacosanyl Hydroxystearate | Topical |
| Hydroxypropyl Cellulose | Topical |
| Hydroxypropyl Methylcellulose 2906 | Ophthalmic |
| Hydroxypropyl-Bcyclodextrin | Intravenous; Infusion (IV) |
| Hypromellose 2208 (15000 Mpa.S) | Vaginal |
| Hypromellose 2910 (15000 Mpa.S) | Nasal; Ophthalmic |
| Hypromelloses | Irrigation; Ophthalmic; Rectal; Topical; Vaginal |
| Imidurea | Topical |
| Iodine | Intra-arterial; Intra-articular; Intracardiac; Intradiscal; Intravascular; Intravenous; Periarticular |
| Iodoxamic Acid | Intravenous |
| Iofetamine Hydrochloride | Intravenous |
| Irish Moss Extract | Topical |
| Isobutane | Topical |
| Isoceteth-20 | Topical |
| Isoleucine | Infusion (IV) |
| Isooctyl Acrylate | Topical |
| Isopropyl Alcohol | Intravenous; Topical |
| Isopropyl Isostearate | Topical |
| Isopropyl Myristate | Auricular (Otic); Topical; Transdermal; Vaginal |
| Isopropyl Myristate-Myristyl Alcohol | Topical |
| Isopropyl Palmitate | Topical; Transdermal |
| Isopropyl Stearate | Topical |
| Isostearic Acid | Topical |
| Isostearyl Alcohol | Topical |
| Isotonic Sodium Chloride Solution | Epidural; Intratracheal; Intravenous; Infusion (IV) |
| Jelene | Ophthalmic; Topical |
| Kaolin | Topical |
| Kathon Cg | Topical |
| Kathon Cg II | Topical |
| Lactate | Topical |
| Lactic Acid | Infiltration (AN); Auricular (Otic); Intramuscular (IM); Infusion (IV); Subcutaneous (SC); Intracardiac; Intravenous; Nerve Block; Topical; Vaginal |
| Lactic Acid, Dl- | Intramuscular (IM); Infusion (IV); Intravesou; Topical; Vaginal |
| Lactic Acid, L- | Intravenous; Subcutanous |
| Lactobionic Acid | Intravenous; Infusion (IV) |
| Lactose | Intramuscular (IM); Infusion (IV); Subcutaneous (SC); Inhalation; Intracavitary; Intravenous; Rectal; Transdermal; Vaginal |
| Lactose Monohydrate | Intramuscular (IM); Infusion (IV); Subcutaneous (SC); Intracavitary; Intravenous; Respiratory (Inhalation); Vaginal |
| Lactose, Hydrous | Intramuscular (IM); Infusion (IV); Intravenous; Vaginal |
| Laneth | Topical |
| Lanolin | Ophthalmic; Rectal; Topical; Vaginal |
| Lanolin Alcohol-Mineral Oil | Topical |
| Lanolin Alcohols | Ophthalmic; Topical |
| Lanolin Anhydrous | Ophthalmic; Topical; Transdermal; Vaginal |
| Lanolin Cholesterols | Topical |
| Lanolin Nonionic Derivatives | Ophthalmic |
| Lanolin, Ethoxylated | Topical |

TABLE 26-continued

| Inactive Ingredients | |
|---|---|
| Inactive Ingredient | Route of Administration |
| Lanolin, Hydrogenated | Topical |
| Lauralkonium Chloride | Ophthalmic |
| Lauramine Oxide | Topical |
| Laurdimonium Hydrolyzed Animal Collagen | Topical |
| Laureth Sulfate | Topical |
| Laureth-2 | Topical |
| Laureth-23 | Topical |
| Laureth-4 | Topical |
| Lauric Diethanolamide | Topical |
| Lauric Myristic Diethanolamide | Topical |
| Lauroyl Sarcosine | Ophthalmic |
| Lauryl Lactate | Transdermal |
| Lauryl Sulfate | Topical |
| Lavandula Angustifolia Flowering Top | Topical |
| Lecithin | Inhalation; Intramuscular; Rectal; Topical; Transdermal; Vaginal |
| Lecithin Unbleached | Topical |
| Lecithin, Egg | Intravenous |
| Lecithin, Hydrogenated | Auricular (Otic) |
| Lecithin, Hydrogenated Soy | Inhalation; Intravenous |
| Lecithin, Soybean | Inhalation; Vaginal |
| Lemon Oil | Topical |
| Leucine | Infusion (IV) |
| Levulinic Acid | Transdermal |
| Lidofenin | Intravenous |
| Light Mineral Oil | Ophthalmic; Rectal; Topical; Vaginal; Transdermal |
| Light Mineral Oil (85 Ssu) | Topical |
| Limonene, (+/−)- | Topical |
| Lipocol Sc-15 | Topical |
| Lysine | Intramuscular (IM); Infusion (IV) |
| Lysine Acetate | Infusion (IV) |
| Lysine Monohydrate | Respiratory (Inhalation) |
| Magnesium Aluminum Silicate | Rectal; Topical; Vaginal |
| Magnesium Aluminum Silicate Hydrate | Rectal; Topical; Vaginal |
| Magnesium Chloride | Intramuscular; Intraocular; Intraperitoneal; Intravitreal; Infusion (IV); Ophthalmic; Subcutaneous |
| Magnesium Nitrate | Topical |
| Magnesium Stearate | Implantation; Intravitreal; Subcutaneous; Topical; Transmucosal; Vaginal |
| Maleic Acid | Intramuscular; Infusion (IV) |
| Mannitol | Intramuscular (IM); Infusion (IV); Subcutanous (SC); Intravenous; Ophthalmic; Parenteral; Respiratory (Inhalation); Submucosal; Topical; Transdermal |
| Maprofix | Topical |
| Mebrofenin | Intravenous |
| Medical Adhesive Modified S-15 | Transdermal |
| Medical Antiform A-F Emulsion | Topical |
| Medronate Disodium | Intravenous |
| Medronic Acid | Intravenous |
| Meglumine | Intra-arterial; Intra-articular; Intracardiac; Intradiscal; Intramuscular; Intrauterine; Intravascular; Intravenous; Infusion (IV); Periarticular; Ureteral; Urethral |
| Menthol | Detanl; Inhalation; Topical |
| Metacresol | Intramuscular (IM); Infusion (IV); Subcutanous (SC); Intradermal |
| Metaphosphoric Acid | Infusion (IV) |
| Methanesulfonic Acid | Intramuscular (IM); Infusion (IV); Subcutaneous (SC) |
| Methionine | Intramuscular; Intrathecal; Intravenous; Infusion (IV); Subcutaneous |
| Methyl Alcohol | Transdermal |
| Methyl Gluceth-10 | Topical |
| Methyl Gluceth-20 | Topical |
| Methyl Gluceth-20 Sesquistearate | Topical |
| Methyl Glucose Sesquistearate | Topical |
| Methyl Laurate | Transdermal |
| Methyl Pyrrolidone | Periodontal; Subcutaneous |
| Methyl Salicylate | Topical |

TABLE 26-continued

| Inactive Ingredients | |
|---|---|
| Inactive Ingredient | Route of Administration |
| Methyl Stearate | Topical; Vaginal |
| Methylboronic Acid | Intravenous |
| Methylcellulose (4000 Mpa.S) | Ophthalmic |
| Methylcelluloses | Intra-articular; Intralesional; Intramuscular; Intrasynovial; Nasal; Ophthalmic; Soft tissue; Topical |
| Methylchloroisothiazolinone | Topical |
| Methylene Blue | Intravenous |
| Methylisothiazolinone | Topical |
| Methylparaben | Infiltration (AN); Auricular (Otic); Caudal Block; Epidural; Intramuscular (IM); Infusion (IV); Subcutaneous (SC); Inhalation; Intra-arterial; Intra-articular; Intrabursal; Intradermal; Intralesional; Intrasynovial; Intravenous; Iontophoresis; Irrigation; Nasal; Nerve Block; Ophthalmic; Peridural; Rectal; Soft tissue; Topical; Ureteral; Urethral; Vaginal |
| Microcrystalline Wax | Topical; Vaginal |
| Mineral Oil | Auricular (Otic); Dental; Ophthalmic; Topical; Transdermal; Vaginal |
| Mono And Diglyceride | Topical |
| Monostearyl Citrate | Topical |
| Monothioglycerol | Infiltration (AN); Caudal Block; Epidural; Intramuscular (IM); Infusion (IV); Subcutanous (SC); Intravenous; Nerve Block |
| Multisterol Extract | Topical |
| Myristyl Alcohol | Topical |
| Myristyl Lactate | Topical |
| Myristyl-.Gamma.-Picolinium Chloride | Intra-articular; Intralesional; Intramuscular; Intrasynovial; Soft tissue |
| N-(Carbamoyl-Methoxy Peg-40)-1,2-Distearoyl-Cephalin Sodium | Intravenous |
| N,N-Dimethylacetamide | Intramuscular; Intravenous; Infusion (IV) |
| Niacinamide | Intramuscular; Infusion (IV); Intra-articular; Intralesional; Intrasynovial; Topical |
| Nioxime | Intravenous |
| Nitric Acid | Inhalation; Infusion (IV); Ophthalmic; Topical; Vaginal |
| Nitrogen | Infiltration (AN); Caudal Block; Dental; Epidural; Intramuscular; Infusion (IV); Subcutanous (SC); Inhalation; Intra-arterial; Intracavitary; Intramuscular (IM); Intrathecal; Intratumor; Intravascular; Intravenous; Intravesical; Irrigation; Nasal; Nerve Block; Ophthalmic; Parenteral; Submucosal; Topical; Transdermal |
| Nonoxynol Iodine | Topical |
| Nonoxynol-15 | Topical |
| Nonoxynol-9 | Ophthalmic; Topical |
| Norflurane | Inhalation; Nasal; Respiratory (Inhalation) |
| Oatmeal | Topical |
| Octadecene-1/Maleic Acid Copolymer | Topical |
| Octanoic Acid | Intravenous |
| Octisalate | Transdermal |
| Octoxynol-1 | Topical |
| Octoxynol-40 | Ophthalmic |
| Octoxynol-9 | Topical |
| Octyldodecanol | Topical; Transdermal; Vaginal |
| Octylphenol Polymethylene | Ophthalmic |
| Oleic Acid | Inhalation; Nasal; Respiratory (Inhalation); Topical; Transdermal |
| Oleth-10/Oleth-5 | Topical |
| Oleth-2 | Topical |
| Oleth-20 | Topical |
| Oleyl Alcohol | Topical; Transdermal |
| Oleyl Oleate | Topical; Transdermal |
| Olive Oil | Topical |
| Oxidronate Disodium | Intravenous |
| Oxyquinoline | Intravenous |
| Palm Kernel Oil | Rectal |
| Palmitamine Oxide | Topical |
| Parabens | Topical |
| Paraffin | Rectal; Topical |
| Paraffin, White Soft | Topical |
| Parfum Creme 45/3 | Topical |
| Peanut Oil | Intramuscular; Intratracheal; Topical; Vaginal |
| Peanut Oil, Refined | Topical |
| Pectin | Dental; Topical |

TABLE 26-continued

Inactive Ingredients

| Inactive Ingredient | Route of Administration |
|---|---|
| Peg 6-32 Stearate/Glycol Stearate | Topical; Vaginal |
| Peg Vegetable Oil | Intramuscular (IM); Infusion (IV); Subcutaneous (SC) |
| Peg-100 Stearate | Topical; Vaginal |
| Peg-12 Glyceryl Laurate | Topical |
| Peg-120 Glyceryl Stearate | Topical; Vaginal |
| Peg-120 Methyl Glucose Dioleate | Topical |
| Peg-15 Cocamine | Topical |
| Peg-150 Distearate | Topical |
| Peg-2 Stearate | Topical; Vaginal |
| Peg-20 Sorbitan Isostearate | Intramuscular |
| Peg-22 Methyl Ether/Dodecyl Glycol Copolymer | Topical |
| Peg-25 Propylene Glycol Stearate | Topical |
| Peg-4 Dilaurate | Topical |
| Peg-4 Laurate | Topical |
| Peg-40 Castor Oil | Intramuscular (IM); Subcutaneous (SC); Infusion (IV) |
| Peg-40 Sorbitan Diisostearate | Dental |
| Peg-45/Dodecyl Glycol Copolymer | Topical |
| Peg-5 Oleate | Topical; Vaginal |
| Peg-50 Stearate | Topical |
| Peg-54 Hydrogenated Castor Oil | Topical |
| Peg-6 Isostearate | Topical |
| Peg-60 Castor Oil | Infusion (IV) |
| Peg-60 Hydrogenated Castor Oil | Topical |
| Peg-7 Methyl Ether | Topical |
| Peg-75 Lanolin | Topical |
| Peg-8 Laurate | Topical |
| Peg-8 Stearate | Topical |
| Pegoxol 7 Stearate | Topical; Vaginal |
| Pentadecalactone | Transdermal |
| Pentaerythritol Cocoate | Topical |
| Pentasodium Pentetate | Intravenous |
| Pentetate Calcium Trisodium | Intrathecal; Intravenous; Infusion (IV) |
| Pentetic Acid | Intrathecal; Intravenous |
| Peppermint Oil | Dental; Topical |
| Perflutren | Intravenous |
| Perfume 25677 | Topical |
| Perfume Bouquet | Topical |
| Perfume E-1991 | Topical |
| Perfume Gd 5604 | Topical |
| Perfume Tana 90/42 Scba | Topical |
| Perfume W-1952-1 | Topical |
| Petrolatum | Auricular (Otic); Ophthalmic; Topical |
| Petrolatum, White | Auricular (Otic); Dental; Nasal; Ophthalmic; Rectal; Topical; Transdermal; Vaginal |
| Petroleum Distillates | Topical |
| Phenol | Intramuscular (IM); Infusion (IV); Subcutaneous (SC); Intra-articular; Intradermal; Intralesional; Intrasynovial; Intravenous; Soft tissue |
| Phenol, Liquefied | Intramuscular (IM); Infusion (IV); Subcutaneous (SC); Intravenous |
| Phenonip | Iontophoresis; Topical |
| Phenoxyethanol | Topical |
| Phenylalanine | Infusion (IV) |
| Phenylethyl Alcohol | Auricular (Otic); Nasal; Ophthalmic |
| Phenylmercuric Acetate | Ophthalmic; Topical; Vaginal |
| Phenylmercuric Nitrate | Intramuscular; Ophthalmic |
| Phosphatidyl Glycerol, Egg | Intravenous |
| Phospholipid | Infusion (IV) |
| Phospholipid, Egg | Intravenous; Infusion (IV) |
| Phospholipon 90 g | Vagianl |
| Phosphoric Acid | Intramuscular (IM); Infusion (IV); Subcutaneous (SC); Infiltration; Intra-articular; Intralesional; Intravenous; Ophthalmic; Soft tissue; Topical; Vaginal |
| Pine Needle Oil (Pinus Sylvestris) | Topical |
| Piperazine Hexahydrate | Vagianl |
| Plastibase-50w | Dental; Topical |
| Polacrilin | Iontophoresis; Transdermal |
| Polidronium Chloride | Ophthalmic; Topical |
| Poloxamer 124 | Topical |

TABLE 26-continued

Inactive Ingredients

| Inactive Ingredient | Route of Administration |
| --- | --- |
| Poloxamer 181 | Topical |
| Poloxamer 182 | Topical |
| Poloxamer 188 | Intravenous; Ophthalmic; Peridontal; Subcutaneous; Topical |
| Poloxamer 237 | Topical |
| Poloxamer 407 | Ophthalmic; Peridontal; Topical |
| Poly(Bis(P-Carboxyphenoxy)Propane Anhydride):Sebacic Acid | Implantation |
| Poly(Dimethylsiloxane/Methylvinylsiloxane/ Methylhydrogensiloxane) Dimethylvinyl Or Dimethylhydroxy Or Trimethyl Endblocked | Vagianl |
| Poly(D1-Lactic-Co-Glycolic Acid), (50:50 | N/A |
| Poly(D1-Lactic-Co-Glycolic Acid), Ethyl Ester Terminated, (50:50 | N/A |
| Polyacrylic Acid (250000 Mw) | Transdermal |
| Polybutene (1400 Mw) | Transdermal |
| Polycarbophil | Ophthalmic; Topical; Vaginal |
| Polyester | Transdermal; Vaginal |
| Polyester Polyamine Copolymer | Transdermal |
| Polyester Rayon | Transdermal |
| Polyethylene Glycol 1000 | Rectal; Respiratory (Inhalation); Topical; Vaginal |
| Polyethylene Glycol 1450 | Topical; Urethral |
| Polyethylene Glycol 1500 | Topical |
| Polyethylene Glycol 1540 | Dental; Rectal; Topical |
| Polyethylene Glycol 200 | Intramuscular; Topical |
| Polyethylene Glycol 300 | Intramuscular (IM); Infusion (IV); Intravenous; Ophthalmic; Topical |
| Polyethylene Glycol 300-1600 | Topical |
| Polyethylene Glycol 3350 | Intra-articular; Intralesional; Intramuscular; Intrasynovial; Nasal; Rectal; Soft tissue; Subcutaneous; Topical; Vaginal |
| Polyethylene Glycol 400 | Intramuscular (IM); Infusion (IV); Intravenous; Nasal; Ophthalmic; Rectal; Topical; Vaginal |
| Polyethylene Glycol 4000 | Intra-articular; Intralesional; Intramuscular; Intrasynovial; Rectal; Soft tissue; Topical; Vaginal |
| Polyethylene Glycol 540 | Topical |
| Polyethylene Glycol 600 | Intravenous; Topical |
| Polyethylene Glycol 6000 | Rectal; Topical; Vaginal |
| Polyethylene Glycol 8000 | Ophthalmic; Rectal; Topical; Vaginal |
| Polyethylene Glycol 900 | Topical |
| Polyethylene High Density Containing Ferric Oxide Black (<1%) | Intrauterine |
| Polyethylene Low Density Containing Barium Sulfate (20-24%) | Initrauterine |
| Polyethylene T | Initrauterine |
| Polyethylene Terephthalates | Transdermal |
| Polyglactin | Dental; Implantation; Intramuscular; Subcutaneous |
| Polyglyceryl-3 Oleate | Vagianl |
| Polyglyceryl-4 Oleate | Vagianl |
| Polyhydroxyethyl Methacrylate | Topical |
| Polyisobutylene | Topical; Transdermal |
| Polyisobutylene (1100000 Mw) | Topical; Transdermal |
| Polyisobutylene (35000 Mw) | Transdermal |
| Polyisobutylene 178-236 | Transdermal |
| Polyisobutylene 241-294 | Transdermal |
| Polyisobutylene 35-39 | Transdermal |
| Polyisobutylene Low Molecular Weight | Transdermal |
| Polyisobutylene Medium Molecular Weight | Transdermal |
| Polyisobutylene/Polybutene Adhesive | Transdermal |
| Polylactide | Intramuscular; Peridontal |
| Polyols | Dental |
| Polyoxyethylene-Polyoxypropylene 1800 | Ophthalmic; Topical |
| Polyoxyethylene Alcohols | Topical |
| Polyoxyethylene Fatty Acid Esters | Intramuscular (IM); Infusion (IV); Subcutaneous (SC); Topical |
| Polyoxyethylene Propylene | Topical |
| Polyoxyl 20 Cetostearyl Ether | Topical |
| Polyoxyl 35 Castor Oil | Intravesical; Infusion (IV); Ophthalmic |
| Polyoxyl 40 Hydrogenated Castor Oil | Dental; Ophthalmic; Topical |
| Polyoxyl 40 Stearate | Auricular (Otic); Dental; Ophthalmic; Topical |
| Polyoxyl 400 Stearate | Nasal; Topical |
| Polyoxyl 6 And Polyoxyl 32 Palmitostearate | Topical |
| Polyoxyl Distearate | Topical |
| Polyoxyl Glyceryl Stearate | Topical |
| Polyoxyl Lanolin | Topical |
| Polyoxyl Palmitate | Vagianl |

TABLE 26-continued

| Inactive Ingredients | |
|---|---|
| Inactive Ingredient | Route of Administration |
| Polyoxyl Stearate | Auricular (Otic); Topical |
| Polypropylene | Intrauterine; Topical; Transdermal |
| Polypropylene Glycol | Intramuscular (IM); Infusion (IV); Ophthalmic |
| Polyquaternium-10 | Topical |
| Polyquaternium-7 (70/30 Acrylamide/Dadmac | N/A |
| Polysiloxane | Intravenous |
| Polysorbate 20 | Auricular (Otic); Intramuscular (IM); Subcutaneous (SC); Intravenous; Infusion (IV); Nasal; Ophthalmic; Topical; Vaginal |
| Polysorbate 40 | Intramuscular (IM); Infusion (IV); Topical |
| Polysorbate 60 | Ophthalmic; Rectal; Topical; Vaginal |
| Polysorbate 65 | Topical |
| Polysorbate 80 | Auricular (Otic); Intra-articular; Intrabursal; Intradermal; Intralesional; Intramuscular; Intrasynovial; Intravenous; Infusion (IV); Nasal; Ophthalmic; Rectal; Soft tissue; Subcutaneous; Topical; Vaginal |
| Polyurethane | Vagianl |
| Polyvinyl Acetate | Transdermal |
| Polyvinyl Alcohol | Auricular (Otic); Intramuscular; Intraocular; Intravitreal; Iontophoresis; Ophthalmic; Topical; Transdermal |
| Polyvinyl Chloride | Transdermal |
| Polyvinyl Chloride-Polyvinyl Acetate Copolymer | Transdermal |
| Polyvinylpyridine | Transdermal |
| Poppy Seed Oil | Intralymphatic; Intrauterine |
| Potash | Topical |
| Potassium Acetate | Ophthalmic; Rectal |
| Potassium Alum | Vagianl |
| Potassium Bicarbonate | Transmucosal |
| Potassium Bisulfite | Intravenous |
| Potassium Chloride | Infiltration (AN); Caudal Block; Epidural; Intraocular; Intravenous; Intravitreal; Infusion (IV); Nerve Block; Ophthalmic |
| Potassium Citrate | Topical |
| Potassium Hydroxide | Intravascular; Intravenous; Infusion (IV); Topical; Vaginal |
| Potassium Metabisulfite | Infiltration (AN); Auricular (Otic); Intramuscular (IM); Infusion (IV); Nerve Block; Rectal |
| Potassium Phosphate, Dibasic | Intra-articular; Intramuscular; Intravenous; Infusion (IV); Subcutaneous |
| Potassium Phosphate, Monobasic | Infiltration (AN); Auricular (Otic); Intramuscular (IM); Infusion (IV); Intra-articular; Intramuterine; Intravenous; Intravesical; Nasal; Nerve Block; Ophthalmic; Subcutaneous |
| Potassium Soap | Topical |
| Potassium Sorbate | Nasal; Ophthalmic; Topical |
| Povidone Acrylate Copolymer | Topical |
| Povidone Hydrogel | Iontophoresis; Topical |
| Povidone K17 | Subcutaneous |
| Povidone K25 | Respiratory (Inhalation) |
| Povidone K29/32 | Ophthalmic; Transdermal; Vaginal |
| Povidone K30 | Ophthalmic |
| Povidone K90 | Ophthalmic; Topical |
| Povidone K90f | Auricular (Otic) |
| Povidone/Eicosene Copolymer | Topical |
| Povidones | Auricular (Otic); Intramuscular; Intravenous; Infusion (IV); Ophthalmic; Subcutaneous; Topical; Transdermal; Vaginal |
| Ppg-12/Smdi Copolymer | Topical |
| Ppg-15 Stearyl Ether | Topical |
| Ppg-20 Methyl Glucose Ether Distearate | Topical |
| Ppg-26 Oleate | Topical |
| Product Wat | Topical |
| Proline | Infusion (IV) |
| Promulgen D | Topical; Vaginal |
| Promulgen G | Topical |
| Propane | Topical |
| Propellant A-46 | Topical |

TABLE 26-continued

Inactive Ingredients

| Inactive Ingredient | Route of Administration |
|---|---|
| Propyl Gallate | Topical; Intramuscular |
| Propylene Carbonate | Topical |
| Propylene Glycol | Auricular (Otic); Dental; Extracorporeal; Intramuscular (IM); Infusion (IV); Inhalation; Intravenous; Nasal; Ophthalmic; Photopheresis; Rectal; Subcutaneous; Topical; Transdermal; Vaginal |
| Propylene Glycol Diacetate | Auricular (Otic); Topical |
| Propylene Glycol Dicaprylate | Topical |
| Propylene Glycol Monolaurate | Transdermal |
| Propylene Glycol Monopalmitostearate | Topical; Vaginal |
| Propylene Glycol Palmitostearate | Topical |
| Propylene Glycol Ricinoleate | Topical |
| Propylene Glycol/Diazolidinyl Urea/Methylparaben/Propylparben | Topical |
| Propylparaben | Inflitration (AN); Auricular (Otic); Intramuscular (IM); Infusion (IV); Subcutaneous (SC); Inhalation; Intra-arterial; Intra-articular; Intrabursal; Intralesional; Intrasynovial; Intravenous; Nasal; Nerve Block; Ophthalmic; Rectal; Soft tissue; Topical; Ureteral; Urethral; Vaginal |
| Protamine Sulfate | Intramuscular (IM); Subcutaneous (SC); Intradermal |
| Protein Hydrolysate | Topical |
| Pvm/Ma Copolymer | Dental |
| Quaternium-15 | Topical |
| Quaternium-15 Cis-Form | Topical; Vaginal |
| Quaternium-52 | Topical |
| Ra-2397 | Transdermal |
| Ra-3011 | Transdermal |
| Saccharin | Inhalation; Topical |
| Saccharin Sodium | Dental; Intramuscular (IM); Infusion (IV); Inhalation; Intravenous; Rectal; Topical |
| Saccharin Sodium Anhydrous | Intramuscular (IM); Infusion (IV); Rectal |
| Safflower Oil | Topical |
| Sd Alcohol 3a | Topical |
| Sd Alcohol 40 | Topical |
| Sd Alcohol 40-2 | Topical |
| Sd Alcohol 40b | Topical |
| Sepineo P 600 | Topical |
| Serine | Infusion (IV) |
| Sesame Oil | Intramuscular (IM); Subcutaneous (SC) |
| Shea Butter | Topical |
| Silastic Brand Medical Grade Tubing | Implantation |
| Silastic Medical Adhesive, Silicone Type A | Implantation |
| Silica, Dental | Dental |
| Silicon | Topical; Transdermal |
| Silicon Dioxide | Dental; Topical; Vaginal |
| Silicon Dioxide, Colloidal | Endocervical; Rectal; Respiratory (Inhalation); Transdermal; Vaginal |
| Silicone | Intramuscular (IM); Infusion (IV); Intrauterine; Topical; Transdermal; Vaginal |
| Silicone Adhesive 4102 | Percutaneous; Transdermal |
| Silicone Adhesive 4502 | Transdermal |
| Silicone Adhesive Bio-Psa Q7-4201 | Transdermal; Topical |
| Silicone Adhesive Bio-Psa Q7-4301 | Transdermal; Topical |
| Silicone Emulsion | Topical |
| Silicone/Polyester Film Strip | Transdermal |
| Simethicone | Intramuscular (IM); Infusion (IV); Rectal; Topical |
| Simethicone Emulsion | Topical |
| Sipon Ls 20np | Topical |
| Soda Ash | Ophthalmic |
| Sodium Acetate | Auricular (Otic); Extracorporeal; Intramuscular (IM); Infusion (IV); Subcutaneous (SC); Interstitial; Intra-articular; Intracavitary; Intradermal; Intralesional; Intraocular; Intraperitoneal; Intrapleural; Intrasynovial; Intravenous; Intravitreal; Nasal; Ophthalmic; Parenteral; Phtotpheresis; Soft tissue; Submucosal; Topical |
| Sodium Acetate Anhydrous | Intramuscular (IM); Infusion (IV); Subcutaneous (SC); Intravenous; Topical |

TABLE 26-continued

Inactive Ingredients

| Inactive Ingredient | Route of Administration |
|---|---|
| Sodium Alkyl Sulfate | Topical |
| Sodium Ascorbate | Intravenous |
| Sodium Benzoate | Dental; Intramuscular (IM); Infusion (IV); Intravenous; Rectal; Topical |
| Sodium Bicarbonate | Intramuscular (IM); Infusion (IV); Intraperitoneal; Intrathecal; Intratracheal; Intravenous; Intravitreal; Subcutaneous; Vaginal |
| Sodium Bisulfate | Intramuscular (IM); Infusion (IV); Subcutaneous (SC); Inhalation; Ophthalmic |
| Sodium Bisulfate | Infiltration (AN); Auricular (Otic); Intramuscular (IM); Infusion (IV); Subcutaneous (SC); Epidural; Inhalation; Intra-arterial; Intra-articular; Intrabursal; Intracardiac; Intradermal; Intradiscal; Intralesional; Intraperitoneal; Intrasynovial; Iontophoresis; Irrigation; Intravenous; Nerve Block; Ophthalmic; soft tissue; Topical |
| Sodium Borate | Auricular (Otic); Ophthalmic; Topical |
| Sodium Borate Decahydrate | Ophthalmic |
| Sodium Carbonate | Infiltration (AN); Intramuscular (IM); Infusion (IV); Intra-arterial; Intraperitoneal; Intrapleural; Intratumor; Intravascular; Intravenous; Intravitreal; Nerve Block; Ophthalmic; Rectal |
| Sodium Carbonate Decahydrate | Intravenous |
| Sodium Carbonate Monohydrate | Intra-arterial; Intracardiac; Intravenous; Ophthalmic |
| Sodium Cetostearyl Sulfate | Topical |
| Sodium Chlorate | Infiltration (AN); Intramuscular; Infusion (IV); Nerve Block |
| Sodium Chloride | Infiltration; Inhalation; Intra-arterial; Intra-articular; Intrabursal; Intracardiac; Intracaudal; Intracavitary; Intradermal; Intralesional; Intramuscular; Intraocular; Intraperitoneal; Intrapleural; Intrasynovial; Intrathecal; Intratracheal; Intratumor; Intravascular; Intravenous; Intravenous bolus; Intravesical; Intravitreal; Iontophoresis; Infusion (IV); Intramuscular (IM); Subcutaneous (SC); Nasal; Nerve Block; Ophthalmic; Parenteral; Peridural; Photopheresis; Rectal; Respiratory (Inhalation); Soft tissue; Subarachnoid; Submucosal; Topical; Transermal |
| Sodium Chloride Injection | Intramuscular |
| Sodium Chloride Injection, Bacteriostatic | Intraveous |
| Sodium Cholesteryl Sulfate | Infusion (IV) |
| Sodium Citrate | Infiltration (AN); Auricular (Otic); Epidural; Intramuscular (IM); Infusion (IV); Subcutaneous (SC); Inhalation; Intra-arterial; Intra-articular; Intracardiac; Intravacitary; Intralesional; Intraocular; Iintraperitoneal; Intrapleural; Intrasynovial; Intrathecal; Intratracheal; Intrauterine; Intravasular; Intravenous; Iontophoresis; Irrigation; Nasal; Nerve Block; Ophthalmic; Rectal; Respiratory (Inhalation); Soft tissue; Topical; Transdermal; Ureteral; Vaginal |
| Sodium Cocoyl Sarcosinate | Topical |
| Sodium Desoxycholate | Infusion (IV) |
| Sodium Dithionite | Intramuscular (IM); Infusion (IV); Subcutaneous (SC); Intravenous |
| Sodium Dodecylbenzenesulfonate | Topical |
| Sodium Formaldehyde Sulfoxylate | Intramuscular (IM); Infusion (IV); Subcutaneous (SC); Topical |
| Sodium Gluconate | Intravenous; Infusion (IV) |
| Sodium Hydroxide | Intrathecal (AN, CNBLK); Infiltration (AN); Sympathetic (AN, NBLK); Auricular (Otic); Caudal Block; Dental; Epidural; Extracorporeal; Intramuscular (IM); Infusion (IV); Subcutaneous (SC); Inflitration; Inhalationi; Interstitial; Intra-amniotic; Intra-arterial; Intra-articular; Intrabursal; Intracardiac; Intracaudl; Intracavitary; Intradermal; Intradiscal; Intralesional; Intraocular; Intraperioneal; Intrapleural; Intraspinal; Intrasynovial; Intrathecal; Intratracheal; Intratumor; Intrauterine; Intravascular; Intravenous; Intravitreal; Iontophoresis; Irrigation; Nasal; Nerve Block; Ophthalmic; Parenteral; Perfusion, cardiac; Peridural; Perineural; Photopheresis; Rectal; Respiratory (Inhalation); Retrobular; Soft tissue; Spinal; Subarachnoid; Subconjunctival; Submucosal; Topical; Transdermal; Ureteral; Urethral; Vaginal |

TABLE 26-continued

| Inactive Ingredients | |
| --- | --- |
| Inactive Ingredient | Route of Administration |
| Sodium Hypochlorite | Infusion (IV) |
| Sodium Iodide | Intravenous; Topical |
| Sodium Lactate | Infiltration (AN); Caudal Black; Intramuscular (IM); Infusion (IV); Subcutaneous (SC); Intracardiac; Intraperitoneal; Intravenous; Nerve Block; Topical |
| Sodium Lactate, L- | Epidural; Intramuscular (IM); Infusion (IV); Subcutaneous (SC); Intracardiac; Nerve Block |
| Sodium Laureth-2 Sulfate | Topical |
| Sodium Laureth-3 Sulfate | Topical |
| Sodium Laureth-5 Sulfate | Topical |
| Sodium Lauroyl Sarcosinate | Topical |
| Sodium Lauryl Sulfate | Dental; Respiratory (Inhalation); Topical; Vaginal |
| Sodium Lauryl Sulfoacetate | Topical |
| Sodium Metabisulfite | Intrathecal (AN, CNBLK); Infiltration (AN); Cardal Block; Dental; Epidural; Intramuscular (IM); Infusion (IV); Subcutaneous (SC); Infiltration; Inhalation; Intra-articular; Initrabursal; Intracardiac; Intramuscular; Intraperitoneal; Intravenous; Iontophoresis; Nerve Block; Ophthalmic; Peridural; Rectal; Submucosal; Topical; Vaginal |
| Sodium Nitrate | Ophthalmic |
| Sodium Phosphate | Intramuscular (IM); Infusion (IV); Intra-articular; Intrabursal; Intradermal; Intralesional; Nasal; Nerve Block; Ophthalmic; Soft tissue; Subcutanesou; Topical |
| Sodium Phosphate Dihydrate | Intramuscular (IM); Subcutaneous (SC); Ophthalmic |
| Sodium Phosphate, Dibasic | Intramuscular (IM); Infusion (IV); Intradermal; Intralesional; Intrasynovial; Intravenous; Nasal; Ophthalmic; Soft tissue; Topical; Subcutaneous (SC) |
| Sodium Phosphate, Dibasic, Anhydrous | Auricular (Otic); Intramuscular (IM); Infusion (IV); Subcutaneous (SC); Intra-articular; Intralesional; Intramuscular; Intravenous; Intravesical; Nasal; Ophthalmic; Topical; Vaginal |
| Sodium Phosphate, Dibasic, Dihydrate | Intramuscular (IM); Infusion (IV); Intravenous; Nasal; Ophthalmic; Subcutaneous; Topical |
| Sodium Phosphate, Dibasic, Dodecahydrate | Nasal |
| Sodium Phosphate, Dibasic, Heptahydrate | Infiltration (AN); Auricular (Otic); Intramuscular (IM); Infusion (IV); Subcutaneous (SC); Iintra-articular; Intrabursal; Intradermal; Intralesional; Intramuscular; Intrasynovial; Intravenous; Intravitreal; Nasal; Nerve Block; Ophthalmic; Soft tissue; Topical; Urethral |
| Sodium Phosphate, Monobasic | Intramuscular (IM); Infusion (IV); Intralesional; Intrasynovial; Iontophoresis; Ophthalmic; Soft tissue; Subcutaneous; Topical |
| Sodium Phosphate, Monobasic, Anhydrous | Auricular (Otic); Intramuscular (IM); Infusion (IV); Intrabursal; Intradermal; Intralesional; Intrasynovial; Intravascular; Intravenous; Intravesical; Nasal; Ophthalmic; Soft tissue; Subcutaneous; Topical; Vaginal |
| Sodium Phosphate, Monobasic, Dihydrate | Intravenous; Infusion (IV); Nasal; Ophthalmic; Subcutaneous; Topical |
| Sodium Phosphate, Monobasic, Monohydrate | Intramuscular (IM); Infusion (IV); Intra-articular; Intralesional; Intravascular; Intravenous; Intravitreal; Ophthalmic; Subcutaneous; Topical |
| Sodium Polyacrylate (2500000 Mw) | Topical |
| Sodium Pyrophosphate | Intravenous |
| Sodium Pyrrolidone Carboxylate | Topical |
| Sodium Starch Glycolate | Transmucosal |
| Sodium Succinate Hexahydrate | Intravenous |
| Sodium Sulfate | Intramuscular (IM); Infusion (IV); Ophthalmic |
| Sodium Sulfate Anhydrous | Inhalation; Iintramuscular; Ophthalmic |
| Sodium Sulfate Decahydrate | Ophthalmic |
| Sodium Sulfite | Auricular (Otic); Epidural; Intramuscular (IM); Infusion (IV); Inhalation; Intra-articular; Intralesional; Intravenous; Ophthalmic; Soft tissue; Subcutaneous; Topical |
| Sodium Sulfosuccinated Undecyclenic Monoalkylolamide | Topical |
| Sodium Tartrate | Intramuscual (IM); Infusion (IV); Intravenous |
| Sodium Thioglycolate | Subcutaneous |
| Sodium Thiomalate | Intramuscular (IM); Infusion (IV) |
| Sodium Thiosulfate | Intravenous; Ophthalmic; Topical |
| Sodium Thiosulfate Anhydrous | Intravenous |
| Sodium Trimetaphosphate | Intravenous |
| Sodium Xylenesulfonate | Topical |

TABLE 26-continued

Inactive Ingredients

| Inactive Ingredient | Route of Administration |
| --- | --- |
| Somay 44 | Topical |
| Sorbic Acid | Ophthalmic; Topical; Vaginal |
| Sorbitan | Topical |
| Sorbitan Isostearate | Topical |
| Sorbitan Monolaurate | Ophthalmic; Topical |
| Sorbitan Monooleate | Rectal; Topical; Transdermal |
| Sorbitan Monopalmitate | Intramuscular; Topical |
| Sorbitan Monostearate | Topical; Vaginal |
| Sorbitan Sesquioleate | Rectal; Topical |
| Sorbitan Trioleate | Inhalation; Nasal |
| Sorbitan Tristearate | Topical |
| Sorbitol | Dental; Intra-articular; Intralesional; Intramuscular; Intrasynovial; Intravenous; Infusion (IV); Nasal; Ophthalmic; Rectal; Topical; Vaginal |
| Sorbitol Solution | Intra-articular; Intralesional; Intramuscular; Intravenous; Infusion (IV); Nasal; Ophthalmic; Rectal; Topical; Vaginal |
| Soybean Flour | Topical |
| Soybean Oil | Intraveous; Infusion (IV); Topical |
| Spearmint Oil | Topical |
| Spermaceti | Topical; Vaginal |
| Squalane | Topical |
| Stabilized Oxychloro Complex | Ophthalmic |
| Stannous 2-Ethylhexanoate | Vagianl |
| Stannous Chloride | Intravenous; Infusion (IV) |
| Stannous Chloride Anhydrous | Intravenous; Infusion (IV) |
| Stannous Fluoride | Intravenous |
| Stannous Tartrate | Intravenous |
| Starch | Intramuscular; Rectal; Topical; Vaginal |
| Starch 1500, Pregelatinized | Vagianl |
| Starch, Corn | Vagianl |
| Stearalkonium Chloride | Topical |
| Stearalkonium Hectorite/Propylene Carbonate | Transdermal |
| Stearamidoethyl Diethylamine | Topical; Vaginal |
| Steareth-10 | Rectal; Topical |
| Steareth-100 | Topical |
| Steareth-2 | Topical |
| Steareth-20 | Topical |
| Steareth-21 | Topical |
| Steareth-40 | Topical; Rectal |
| Stearic Acid | Implantation; Subcutaneous; Topical; Vaginal |
| Stearic Diethanolamide | Topical |
| Stearoxytrimethylsilane | Topical |
| Steartrimonium Hydrolyzed Animal Collagen | Topical |
| Stearyl Alcohol | Topical; Vaginal |
| Sterile Water For Inhalation | Infusion (IV) |
| Styrene/Isoprene/Styrene Block Copolymer | Topical |
| Succimer | Intravenous |
| Succinic Acid | Intramuscular (IM); Infusion (IV); Intravenous |
| Sucralose | Nasa |
| Sucrose | Intramuscular; Intravenous; Infusion (IV); Rectal; Subcutaneous; Topical |
| Sucrose Distearate | Topical |
| Sucrose Polyesters | Topical |
| Sulfacetamide Sodium | Topical |
| Sulfobutylether .Beta.-Cyclodextrin | Intramuscular; Intravenous; Infusion (IV) |
| Sulfur Dioxide | Infusion (IV) |
| Sulfuric Acid | Auricular (Otic); Epidural; Intramuscular (IM); Infusion (IV); Inhalation; Intraperitoneal; Intravenous; Irrigation; Nasal; Ophthalmic; Respiratory (Inhalation); Topical |
| Sulfurous Acid | Intramuscular |
| Surfactol Qs | Topical |
| Tagatose, D- | Rectal |
| Talc | Topical |
| Tall Oil | Topical |
| Tallow Glycerides | Topical |
| Tartaric Acid | Intramuscular; Intravenous; Infusion (IV); Topical |
| Tartaric Acid, Dl- | Intramuscular (IM); Infusion (IV); Intravenous; Rectal; Vaginal |
| Tenox | Topical |
| Tenox-2 | Topical |
| Tert-Butyl Alcohol | Intravenous; Infusion (IV); Topical |
| Tert-Butyl Hydroperoxide | Topical |

TABLE 26-continued

| Inactive Ingredients | |
|---|---|
| Inactive Ingredient | Route of Administration |
| Tert-Butylhydroquinone | Vagianl |
| Tetrakis(2-Methoxyisobutylisocyanide)Copper(I) Tetrafluoroborate | Intravenous |
| Tetrapropyl Orthosilicate | Vagianl |
| Tetrofosmin | Infusion (IV) |
| Theophylline | Intravenous; Infusion (IV) |
| Thimerosal | Auricular (Otic); Intramuscular (IM); Infusion (IV); Subcutaneous (SC); Intravenous; Ophthalmic; Topical |
| Threonine | Intravenous; Infusion (IV) |
| Thymol | Inhalation |
| Tin | Intravenous |
| Titanium Dioxide | Dental; Intrauterine; Ophthalmic; Respiratory (Inhalation); Topical; Transdermal |
| Tocopherol | Topical |
| Tocophersolan | Ophthalmic; Topical |
| Triacetin | Endocervical; Transdermal |
| Tricaprylin | Epidural; Infiltration |
| Trichloromonofluoromethane | Inhalation; Nasal; Topical |
| Trideceth-10 | Topical |
| Triethanolamine Lauryl Sulfate | Topical |
| Trifluoroacetic Acid | Infusion (IV) |
| Triglycerides, Medium Chain | Topical |
| Trihydroxystearin | Topical |
| Trilaneth-4 Phosphate | Topical |
| Trilaureth-4 Phosphate | Topical |
| Trisodium Citrate Dihydrate | Intramuscular (IM); Infusion (IV); Intravenous; Intravitreal; Nasal; Ophthalmic; Topical |
| Trisodium Hedta | Topical |
| Triton 720 | Ophthalmic |
| Triton X-200 | Topical |
| Trolamine | Rectal; Topical; Transdermal; Vaginal |
| Tromantadine | Intramuscular; Intravenous |
| Tromethamine | Intramuscular (IM); Infusion (IV); Intra-arterial; Intrathecal; Intratracheal; Intravasular; Intravenous; Ophthalmic; Rectal; Respiratory (Inhalation); Subcutaneous; Topical; Transdermal; Urethral |
| Tryptophan | Infusion (IV) |
| Tyloxapol | Ophthalmic; Topical |
| Tyrosine | Infusion (IV) |
| Undecylenic Acid | Topical |
| Union 76 Amsco-Res 6038 | Transdermal |
| Urea | Intramuscular; Vaginal |
| Valine | Infusion (IV) |
| Vegetable Oil | Topical |
| Vegetable Oil Glyceride, Hydrogenated | Rectal |
| Vegetable Oil, Hydrogenated | Rectal; Topical; Vaginal |
| Versetamide | Intravenous |
| Viscarin | Topical |
| Viscose/Cotton | Transdermal |
| Vitamin E | Topical |
| Wax, Emulsifying | Rectal; Topical |
| Wecobee Fs | Topical; Vaginal |
| White Ceresin Wax | Vagianl |
| White Wax | Rectal; Topical; Vaginal |
| Xanthan Gum | Rectal; Topical |
| Zinc | Subcutaneous |
| Zinc Acetate | Subcutaneous, Topical |
| Zinc Carbonate | Subcutaneous |
| Zinc Chloride | Intramuscular (IM); Subcutaneous (SC); Intradermal; Ophthalmic |
| Zinc Oxide | Intramuscular (IM); Subcutaneous (SC); Rectal; Respiratory (Inhalation) |

Delivery

The present disclosure encompasses the delivery of NAVs for any of therapeutic, pharmaceutical, diagnostic or imaging by any appropriate route taking into consideration likely advances in the sciences of drug delivery. Delivery may be naked or formulated.

Naked Delivery

The NAVs of the present invention may be delivered to a cell naked. As used herein in, "naked" refers to delivering NAVs free from agents which promote transfection. For example, the NAVs delivered to the cell may contain no modifications. The naked NAVs may be delivered to the cell using routes of administration known in the art and described herein.

Formulated Delivery

The NAVs of the present invention may be formulated, using the methods described herein. The formulations may contain polynucleotides which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated NAVs may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Administration

The NAVs of the present invention may be administered by any route which results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique, ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions may be administered in a way which allows them cross the blood-brain barrier, vascular barrier, or other epithelial barrier. In one embodiment, a formulation for a route of administration may include at least one inactive ingredient. Non-limiting examples of routes of administration and inactive ingredients which may be included in formulations for the specific route of administration is shown in Table 20. In Table 27, "AN" means anesthetic, "CNBLK" means cervical nerve block, "NBLK" means nerve block, "IV" means intravenous, "TM" means intramuscular and "SC" means subcutaneous.

TABLE 27

Routes of Adminsitration and Inactive Ingredients

| Route of Administration | Inactive Ingredient |
| --- | --- |
| Intrathecal (AN, CNBLK) | Acetone Sodium Bisulfite; Citric Acid; Hydrochloric Acid; Sodium Chloride; Sodium Hydroxide; Sodium Metabisulfite |
| Infiltration (AN) | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium Chloride; Sodium Citrate; Sodium Hydroxide; Sodium Lactate; Sodium Metabisulfite; Sodium Phosphate, Dibasic, Heptahydrate |
| Sympathetic NBLK (AN) | Hydrochloric Acid; Sodium Chloride; Sodium Hydroxide |
| Auricular (Otic) | Acetic Acid; Aluminum Acetate; Aluminum Sulfate Anhydrous; Benzalkonium Chloride; Benzethonium Chloride; Benzyl Alcohol; Boric Acid; Calcium Carbonate; Cetyl Alcohol; Chlorobutanol; Chloroxylenol; Citric Acid; Creatinine; Cupric Sulfate; Cupric Sulfate Anhydrous; Edetate Disodium; Edetic Acid; Glycerin; Glyceryl Stearate; Hydrochloric Acid; Hydrocortisone; Hydroxyethyl Cellulose; Isopropyl Myristate; Lactic Acid; Lecithin, Hydrogenated; Methylparaben; Mineral Oil; Petrolatum; Petrolatum, White; Phenylethyl Alcohol; Polyoxyl 40 Stearate; Polyoxyl Stearate; Polysorbate 20; Polysorbate 80; Polyvinyl Alcohol; Potassium Metabisulfite; Potassium Phosphate, Monobasic; Povidone K90f; Povidones; Propylene Glycol; Propylene Glycol Diacetate; Propylparaben; Sodium Acetate; Sodium Bisulfite; Sodium Borate; Sodium Chloride; Sodium Citrate; Sodium Hydroxide; Sodium Phosphate, Dibasic, Anhydrous; Sodium Phosphate, Dibasic, Heptahydrate; Sodium Phosphate, Monobasic, Anhydrous; Sodium Sulfite; Sulfuric Acid; Thimerosal |
| Caudal Block | Ascorbic Acid; Calcium Chloride; Citric Acid; Edetate Calcium Disodium; Edetate Disodium; Hydrochloric Acid; Methylparaben; Monothioglycerol; Nitrogen; Potassium Chloride; Sodium Chloride; Sodium Hydroxide; Sodium Lactate; Sodium Metabisulfite |
| Dental | Acetone Sodium Bisulfite; Alcohol; Alcohol, Dehydrated; Alcohol, Denatured; Anethole; Benzyl Alcohol; Carboxymethylcellulose Sodium; Carrageenan; D&C Yellow No. 10; Dimethicone Medical Fluid 360; Eucalyptol; Fd&C Blue No. 1; Fd&C Green No. 3; Flavor 89-186; Flavor 89-259; Flavor Df-119; Flavor Df-1530; Flavor Enhancer; Gelatin; Gelatin, Crosslinked; Glycerin; Glyceryl Stearate; High Density Polyethylene; Hydrocarbon Gel, Plasticized; Hydrochloric Acid; Menthol; Mineral Oil; Nitrogen; Pectin; Peg-40 Sorbitan Diisostearate; Peppermint Oil; Petrolatum, White; Plastibase-50w; Polyethylene Glycol 1540; Polyglactin; Polyols; Polyoxyl 40 Hydrogenated Castor Oil; Polyoxyl 40 Stearate; Propylene Glycol; Pvm/Ma Copolymer; Saccharin Sodium; Silica, Dental; Silicon Dioxide; Sodium Benzoate; Sodium Chloride; Sodium Hydroxide; Sodium Lauryl Sulfate; Sodium Metabisulfite; Sorbitol; Titanium Dioxide |
| Diagnostic | Hydrochloric Acid |
| Endocervical | Colloidal Silicon Dioxide; Triacetin |
| Epidural | 1,2-Dioleoyl-Sn-Glycero-3-Phosphocholine; 1,2-Dipalmitoyl-Sn-Glycero-3-(Phospho-Rac-(1-Glycerol)); Ascorbic Acid; Benzyl Alcohol; Calcium Chloride; Cholesterol; Citric Acid; Edetate Calcium Disodium; Edetate Disodium; Glyceryl Trioleate; Hydrochloric Acid; Isotonic Sodium Chloride Solution; Methylparaben; Monothioglycerol; Nitrogen; Potassium Chloride; Sodium Bisulfite; Sodium Chloride; Sodium Citrate; Sodium Hydroxide; Sodium Lactate, L-; Sodium Metabisulfite; Sodium Sulfite; Sulfuric Acid; Tricaprylin |
| Extracorporeal | Acetic Acid; Alcohol, Dehydrated; Benzyl Alcohol; Hydrochloric Acid; Propylene Glycol; Sodium Acetate; Sodium Chloride; Sodium Hydroxide |
| Intramuscular-Intravenous | Acetic Acid; Alcohol; Alcohol, Dehydrated; Alcohol, Diluted; Anhydrous Dextrose; Anhydrous Lactose; Anhydrous Trisodium Citrate; Arginine; Ascorbic Acid; Benzethonium Chloride; Benzoic Acid; Benzyl Alcohol; Calcium Chloride; Carbon Dioxide; Chlorobutanol; Citric Acid; Citric Acid Monohydrate; Creatinine; Dextrose; Edetate Calcium Disodium; Edetate Disodium; Edetate Sodium; Gluconolactone; Glycerin; Hydrochloric Acid; Hydrochloric Acid, Diluted; Lactic Acid; Lactic Acid, Dl-; Lactose; Lactose Monohydrate; Lactose, Hydrous; Lysine; Mannitol; Methylparaben; Monothioglycerol; Niacinamide; Nitrogen; Phenol; Phenol, Liquefied; Phosphoric Acid; Polyethylene Glycol 300; Polyethylene Glycol 400; Polypropylene Glycol; Polysorbate 40; Potassium Metabisulfite; Potassium Phosphate, Monobasic; Propylene Glycol; Propylparaben; |

TABLE 27-continued

Routes of Adminsitration and Inactive Ingredients

| Route of Administration | Inactive Ingredient |
|---|---|
| | Saccharin Sodium; Saccharin Sodium Anhydrous; Silicone; Simethicone; Sodium Acetate; Sodium Acetate Anhydrous; Sodium Benzoate; Sodium Bicarbonate; Sodium Bisulfate; Sodium Bisulfite; Sodium Carbonate; Sodium Chloride; Sodium Citrate; Sodium Formaldehyde Sulfoxylate; Sodium Hydroxide; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate; Sodium Sulfite; Sodium Tartrate; Sodium Thiomalate; Succinic Acid; Sulfuric Acid; Tartaric Acid, Dl-; Thimerosal; Trisodium Citrate Dihydrate; Tromethamine |
| Intramuscular-Intravenous-Subcutaneous | Acetic Acid; Alcohol; Alcohol, Dehydrated; Benzyl Alcohol; Chlorobutanol; Citric Acid; Citric Acid Monohydrate; Citric Acid, Hydrous; Creatinine; Dextrose; Edetate Disodium; Edetate Sodium; Gelatin; Glycerin; Glycine; Hydrochloric Acid; Hydrochloric Acid, Diluted; Lactic Acid; Lactose; Lactose Monohydrate; Metacresol; Methanesulfonic Acid; Methylparaben; Monothioglycerol; Nitrogen; Phenol; Phosphoric Acid; Polyoxyethylene Fatty Acid Esters; Propylparaben; Sodium Acetate; Sodium Bisulfate; Sodium Bisulfite; Sodium Chloride; Sodium Citrate; Sodium Dithionite; Sodium Hydroxide; Sodium Lactate; Sodium Lactate, L-; Sodium Metabisulfite; Sodium Phosphate, Dibasic, Heptahydrate; Thimerosal |
| Intramuscular - Subcutaneous | Acetic Acid; Anhydrous Dextrose; Benzyl Alcohol; Chlorobutanol; Citric Acid; Cysteine; Edetate Disodium; Gelatin; Glycerin; Glycine; Hydrochloric Acid; Lactose Monohydrate; Mannitol; Metacresol; Methylparaben; Nitrogen; Peg Vegetable Oil; Peg-40 Castor Oil; Phenol; Phenol, Liquefied; Phosphoric Acid; Polyoxyethylene Fatty Acid Esters; Polysorbate 20; Propylparaben; Protamine Sulfate; Sesame Oil; Sodium Acetate; Sodium Acetate Anhydrous; Sodium Chloride; Sodium Citrate; Sodium Formaldehyde Sulfoxylate; Sodium Hydroxide; Sodium Phosphate Dihydrate; Sodium Phosphate, Dibasic, Heptahydrate; Sulfuric Acid; Thimerosal; Zinc Chloride; Zinc Oxide |
| Implantation | Acetone; Crospovidone; Dimethylsiloxane/Methylvinylsiloxane Copolymer; Ethylene Vinyl Acetate Copolymer; Magnesium Stearate; Poly(Bis(P-Carboxyphenoxy)Propane Anhydride): Sebacic Acid; Polyglactin; Silastic Brand Medical Grade Tubing; Silastic Medical Adhesive, Silicone Type A; Stearic Acid |
| Infiltration | Cholesterol; Citric Acid; Diethyl Pyrocarbonate; Dipalmitoylphosphatidylglycerol, Dl-; Hydrochloric Acid; Nitrogen; Phosphoric Acid; Sodium Chloride; Sodium Hydroxide; Sodium Metabisulfite; Tricaprylin |
| Inhalation | Acetone Sodium Bisulfite; Acetylcysteine; Alcohol; Alcohol, Dehydrated; Ammonia; Ascorbic Acid; Benzalkonium Chloride; Carbon Dioxide; Cetylpyridinium Chloride; Chlorobutanol; Citric Acid; D&C Yellow No. 10; Dichlorodifluoromethane; Dichlorotetrafluoroethane; Edetate Disodium; Edetate Sodium; Fd&C Yellow No. 6; Fluorochlorohydrocarbons; Glycerin; Hydrochloric Acid; Hydrochloric Acid, Diluted; Lactose; Lecithin; Lecithin, Hydrogenated Soy; Lecithin, Soybean; Menthol; Methylparaben; Nitric Acid; Nitrogen; Norflurane; Oleic Acid; Propylene Glycol; Propylparaben; Saccharin; Saccharin Sodium; Sodium Bisulfate; Sodium Bisulfite; Sodium Chloride; Sodium Citrate; Sodium Hydroxide; Sodium Metabisulfite; Sodium Sulfate Anhydrous; Sodium Sulfite; Sorbitan Trioleate; Sulfuric Acid; Thymol; Trichloromonofluoromethane |
| Interstitial | Benzyl Alcohol; Dextrose; Hydrochloric Acid; Sodium Acetate; Sodium Hydroxide |
| Intra-amniotic | Citric Acid; Edetate Disodium Anhydrous; Hydrochloric Acid; Sodium Hydroxide |
| Intra-arterial | Anhydrous Trisodium Citrate; Benzyl Alcohol; Carbon Dioxide; Citric Acid; Diatrizoic Acid; Edetate Calcium Disodium; Edetate Disodium; Hydrochloric Acid; Hydrochloric Acid, Diluted; Iodine; Meglumine; Methylparaben; Nitrogen; Propylparaben; Sodium Bisulfite; Sodium Carbonate; Sodium Carbonate Monohydrate; Sodium Chloride; Sodium Citrate; Sodium Hydroxide; Tromethamine |
| Intra-articular | Acetic Acid; Anhydrous Trisodium Citrate; Benzalkonium Chloride; Benzyl Alcohol; Carboxymethylcellulose; Carboxymethylcellulose Sodium; Cellulose, Microcrystalline; Citric Acid; Creatine; Creatinine; Crospovidone; Diatrizoic Acid; Edetate Calcium Disodium; Edetate Disodium; Hyaluronate Sodium; Hydrochloric Acid; Iodine; Meglumine; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Potassium Phosphate, Dibasic; Potassium Phosphate, Monobasic; |

TABLE 27-continued

Routes of Adminsitration and Inactive Ingredients

| Route of Administration | Inactive Ingredient |
|---|---|
| | Propylparaben; Sodium Acetate; Sodium Bisulfite; Sodium Chloride; Sodium Citrate; Sodium Hydroxide; Sodium Metabisulfite; Sodium Phosphate; Sodium Phosphate, Dibasic, Anhydrous; Sodium Phosphate, Dibasic, Heptahydrate; Sodium Phosphate, Monobasic, Anhydrous; Sodium Phosphate, Monobasic, Monohydrate; Sodium Sulfite; Sorbitol; Sorbitol Solution |
| Intrabursal | Anhydrous Trisodium Citrate; Benzalkonium Chloride; Benzyl Alcohol; Carboxymethylcellulose; Carboxymethylcellulose Sodium; Citric Acid; Creatinine; Edetate Disodium; Hydrochloric Acid; Methylparaben; Polysorbate 80; Propylparaben; Sodium Bisulfite; Sodium Chloride; Sodium Hydroxide; Sodium Metabisulfite; Sodium Phosphate; Sodium Phosphate, Dibasic, Heptahydrate; Sodium Phosphate, Monobasic, Anhydrous |
| Intracardiac | Carbon Dioxide; Citric Acid; Citric Acid Monohydrate; Diatrizoic Acid; Edetate Calcium Disodium; Edetate Disodium; Hydrochloric Acid; Iodine; Lactic Acid; Meglumine; Sodium Bisulfite; Sodium Carbonate Monohydrate; Sodium Chloride; Sodium Citrate; Sodium Hydroxide; Sodium Lactate; Sodium Lactate, L-; Sodium Metabisulfite |
| Intracaudal | Hydrochloric Acid; Sodium Chloride; Sodium Hydroxide |
| Intracavitary | Alcohol, Dehydrated; Alfadex; Anhydrous Lactose; Benzyl Alcohol; Dextrose; Hydrochloric Acid; Lactose; Lactose Monohydrate; Nitrogen; Sodium Acetate; Sodium Chloride; Sodium Citrate; Sodium Hydroxide |
| Intradermal | Benzalkonium Chloride; Benzyl Alcohol; Carboxymethylcellulose Sodium; Creatinine; Edetate Disodium; Glycerin; Hydrochloric Acid; Metacresol; Methylparaben; Phenol; Polysorbate 80; Protamine Sulfate; Sodium Acetate; Sodium Bisulfite; Sodium Chloride; Sodium Hydroxide; Sodium Phosphate; Sodium Phosphate, Dibasic; Sodium Phosphate, Dibasic, Heptahydrate; Sodium Phosphate, Monobasic, Anhydrous; Zinc Chloride |
| Intradiscal | Cysteine Hydrochloride Anhydrous; Cysteine, Dl-; Diatrizoic Acid; Edetate Calcium Disodium; Edetate Disodium; Iodine; Meglumine; Sodium Bisulfite; Sodium Hydroxide |
| Intralesional | Acetic Acid; Benzalkonium Chloride; Benzyl Alcohol; Carboxymethylcellulose; Carboxymethylcellulose Sodium; Citric Acid; Creatine; Creatinine; Edetate Disodium; Hydrochloric Acid; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfite; Sorbitol; Sorbitol Solution |
| Intralymphatic | Poppy Seed Oil |
| Intramuscular | Acetic Acid; Activated Charcoal; Adipic Acid; Alcohol; Alcohol, Dehydrated; Ammonium Acetate; Anhydrous Dextrose; Ascorbic Acid; Benzalkonium Chloride; Benzethonium Chloride; Benzoic Acid; Benzyl Alcohol; Benzyl Benzoate; Butylated Hydroxyanisole; Butylated Hydroxytoluene; Butylparaben; Calcium; Calcium Chloride; Carbon Dioxide; Carboxymethylcellulose; Carboxymethylcellulose Sodium; Castor Oil; Cellulose, Microcrystalline; Chlorobutanol; Chlorobutanol Hemihydrate; Chlorobutanol, Anhydrous; Citric Acid; Citric Acid Monohydrate; Corn Oil; Cottonseed Oil; Creatine; Creatinine; Croscarmellose Sodium; Crospovidone; Dextrose; Diatrizoic Acid; Docusate Sodium; Edetate Calcium Disodium; Edetate Disodium; Edetate Disodium Anhydrous; Edetate Sodium; Ethyl Acetate; Gelatin; Glutathione; Glycerin; Glycine; Hyaluronate Sodium; Hydrochloric Acid; Hydroxide Ion; Lactic Acid; Lactic Acid, Dl-; Lactose; Lactose Monohydrate; Lactose, Hydrous; Lecithin; Magnesium Chloride; Maleic Acid; Mannitol; Meglumine; Metacresol; Methionine; Methylcelluloses; Methylparaben; Monothioglycerol; Myristyl-.Gamma.-Picolinium Chloride; N,N-Dimethylacetamide; Niacinamide; Nitrogen; Peanut Oil; Peg-20 Sorbitan Isostearate; Phenol; Phenylmercuric Nitrate; Phosphoric Acid; Polyethylene Glycol 200; Polyethylene Glycol 300; Polyethylene Glycol 3350; Polyethylene Glycol 4000; Polyglactin; Polylactide; Polysorbate 20; Polysorbate 40; Polysorbate 80; Polyvinyl Alcohol; Potassium Phosphate, Dibasic; Potassium Phosphate, Monobasic; Povidones; Propyl Gallate; Propylene Glycol; Propylparaben; Saccharin Sodium; Saccharin Sodium Anhydrous; Sesame Oil; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Chloride Injection; Sodium Citrate; Sodium Formaldehyde Sulfoxylate; Sodium Hydroxide; Sodium Metabisulfite; Sodium Phosphate; Sodium |

TABLE 27-continued

Routes of Adminsitration and Inactive Ingredients

| Route of Administration | Inactive Ingredient |
|---|---|
| | Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate Anhydrous; Sodium Sulfite; Sodium Tartrate; Sorbitan Monopalmitate; Sorbitol; Sorbitol Solution; Starch; Sucrose; Sulfobutylether .Beta.-Cyclodextrin; Sulfuric Acid; Sulfurous Acid; Tartaric Acid; Thimerosal; Tromantadine; Tromethamine; Urea |
| Intraocular | Benzalkonium Chloride; Calcium Chloride; Citric Acid Monohydrate; Hydrochloric Acid; Magnesium Chloride; Polyvinyl Alcohol; Potassium Chloride; Sodium Acetate; Sodium Chloride; Sodium Citrate; Sodium Hydroxide |
| Intraperitoneal | Benzyl Alcohol; Calcium Chloride; Dextrose; Edetate Calcium Disodium; Hydrochloric Acid; Magnesium Chloride; Sodium Acetate; Sodium Bicarbonate; Sodium Bisulfite; Sodium Carbonate; Sodium Chloride; Sodium Citrate; Sodium Hydroxide; Sodium Lactate; Sodium Metabisulfite; Sulfuric Acid |
| Intrapleural | Benzyl Alcohol; Citric Acid; Dextrose; Dichlorodifluoromethane; Hydrochloric Acid; Sodium Acetate; Sodium Carbonate; Sodium Chloride; Sodium Citrate; Sodium Hydroxide |
| Intraspinal | Dextrose; Hydrochloric Acid; Sodium Hydroxide |
| Intrasynovial | Acetic Acid; Benzyl Alcohol; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Niacinamide; Phenol; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate, Dibasic; Sodium Phosphate, Dibasic, Heptahydrate; Sodium Phosphate, Monobasic; Sodium Phosphate, Monobasic, Anhydrous; Sorbitol |
| Intrathecal | Benzyl Alcohol; Carbon Dioxide; Citric Acid; Edetate Calcium Disodium; Hydrochloric Acid; Methionine; Nitrogen; Pentetate Calcium Trisodium; Pentetic Acid; Sodium Bicarbonate; Sodium Chloride; Sodium Citrate; Sodium Hydroxide; Sulfuric Acid; Tromethamine |
| Intratracheal | Acetic Acid; Benzyl Alcohol; Carboxymethylcellulose Sodium; Hydrochloric Acid; Isotonic Sodium Chloride Solution; Peanut Oil; Sodium Bicarbonate; Sodium Chloride; Sodium Citrate; Sodium Hydroxide; Tromethamine |
| Intratumor | Benzyl Alcohol; Hydrochloric Acid; Nitrogen; Sodium Carbonate; Sodium Chloride; Sodium Hydroxide |
| Intrauterine | Barium Sulfate; Crospovidone; Diatrizoic Acid; Dimethylsiloxane/Methylvinylsiloxane Copolymer; Edetate Calcium Disodium; Edetate Disodium; Ethylene Vinyl Acetate Copolymer; High Density Polyethylene; Meglumine; Polyethylene High Density Containing Ferric Oxide Black (<1%); Polyethylene Low Density Containing Barium Sulfate (20-24%); Polyethylene T; Polypropylene; Poppy Seed Oil; Potassium Phosphate, Monobasic; Silicone; Sodium Citrate; Sodium Hydroxide; Titanium Dioxide |
| Intravascular | Alcohol; Alcohol, Dehydrated; Calcium Chloride; Carbon Dioxide; Citric Acid; Diatrizoic Acid; Edetate Calcium Disodium; Edetate Disodium; Hydrochloric Acid; Hydrochloric Acid, Diluted; Iodine; Meglumine; Nitrogen; Potassium Hydroxide; Sodium Carbonate; Sodium Chloride; Sodium Citrate; Sodium Hydroxide; Sodium Phosphate, Monobasic, Anhydrous; Sodium Phosphate, Monobasic, Monohydrate; Tromethamine |
| Intravenous | Alpha-Tocopherol; Alpha-Tocopherol, Dl-; 1,2-Dimyristoyl-Sn-Glycero-3-Phosphocholine; 1,2-Distearoyl-Sn-Glycero-3-(Phospho-Rac-(1-Glycerol)); 1,2-Distearoyl-Sn-Glycero-3-Phosphocholine; Acetic Acid; Acetic Acid, Glacial; Acetic Anhydride; Acetylated Monoglycerides; Acetyltryptophan, Dl-; Activated Charcoal; Albumin Aggregated; Albumin Colloidal; Albumin Human; Alcohol; Alcohol, Dehydrated; Alcohol, Denatured; Ammonium Acetate; Ammonium Hydroxide; Ammonium Sulfate; Anhydrous Citric Acid; Anhydrous Dextrose; Anhydrous Lactose; Anhydrous Trisodium Citrate; Arginine; Ascorbic Acid; Benzenesulfonic Acid; Benzethonium Chloride; Benzoic Acid; Benzyl Alcohol; Benzyl Chloride; Bibapcitide; Boric Acid; Butylated Hydroxytoluene; Calcium Chloride; Calcium Gluceptate; Calcium Hydroxide; Calcobutrol; Caldiamide Sodium; Caloxetate Trisodium; Calteridol Calcium; Captisol; Carbon Dioxide; Cellulose, Microcrystalline; Chlorobutanol; Chlorobutanol Hemihydrate; Chlorobutanol, Anhydrous; Cholesterol; Citrate; Citric Acid; Citric Acid Monohydrate; Citric Acid, Hydrous; Cysteine; Cysteine Hydrochloride; Dalfampridine; Dextran; Dextran 40; Dextrose; Dextrose Monohydrate; Dextrose Solution; Diatrizoic Acid; Dimethicone Medical Fluid 360; Edetate Calcium Disodium; Edetate |

TABLE 27-continued

Routes of Adminsitration and Inactive Ingredients

| Route of Administration | Inactive Ingredient |
|---|---|
| | Disodium; Edetate Disodium Anhydrous; Egg Phospholipids; Ethanolamine Hydrochloride; Ethylenediamine; Exametazime; Ferric Chloride; Gadolinium Oxide; Gamma Cyclodextrin; Gelatin; Gentisic Acid; Gluceptate Sodium; Gluceptate Sodium Dihydrate; Gluconolactone; Glucuronic Acid; Glycerin; Glycine; Guanidine Hydrochloride; Hetastarch; Histidine; Human Albumin Microspheres; Hydrochloric Acid; Hydrochloric Acid, Diluted; Hydroxyethylpiperazine Ethane Sulfonic Acid; Hydroxypropyl-Bcyclodextrin; Iodine; Iodoxamic Acid; Iofetamine Hydrochloride; Isopropyl Alcohol; Isotonic Sodium Chloride Solution; Lactic Acid; Lactic Acid, Dl-; Lactic Acid, L-; Lactobionic Acid; Lactose; Lactose Monohydrate; Lactose, Hydrous; Lecithin, Egg; Lecithin, Hydrogenated Soy; Lidofenin; Mannitol; Mebrofenin; Medronate Disodium; Medronic Acid; Meglumine; Methionine; Methylboronic Acid; Methylene Blue; Methylparaben; Monothioglycerol; N-(Carbamoyl-Methoxy Peg-40)-1,2-Distearoyl-Cephalin Sodium; N,N-Dimethylacetamide; Nioxime; Nitrogen; Octanoic Acid; Oxidronate Disodium; Oxyquinoline; Pentasodium Pentetate; Pentetate Calcium Trisodium; Pentetic Acid; Perflutren; Phenol; Phenol, Liquefied; Phosphatidyl Glycerol, Egg; Phospholipid, Egg; Phosphoric Acid; Poloxamer 188; Polyethylene Glycol 300; Polyethylene Glycol 400; Polyethylene Glycol 600; Polysiloxane; Polysorbate 20; Polysorbate 80; Potassium Bisulfite; Potassium Chloride; Potassium Hydroxide; Potassium Metabisulfite; Potassium Phosphate, Dibasic; Potassium Phosphate, Monobasic; Povidones; Propylene Glycol; Propylparaben; Saccharin Sodium; Sodium Acetate; Sodium Acetate Anhydrous; Sodium Ascorbate; Sodium Benzoate; Sodium Bicarbonate; Sodium Bisulfite; Sodium Carbonate; Sodium Carbonate Decahydrate; Sodium Carbonate Monohydrate; Sodium Chloride; Sodium Chloride Injection, Bacteriostatic; Sodium Citrate; Sodium Dithionite; Sodium Gluconate; Sodium Hydroxide; Sodium Iodide; Sodium Lactate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic, Anhydrous; Sodium Phosphate, Monobasic, Dihydrate; Sodium Phosphate, Monobasic, Monohydrate; Sodium Pyrophosphate; Sodium Succinate Hexahydrate; Sodium Sulfite; Sodium Tartrate; Sodium Thiosulfate; Sodium Thiosulfate Anhydrous; Sodium Trimetaphosphate; Sorbitol; Sorbitol Solution; Soybean Oil; Stannous Chloride; Stannous Chloride Anhydrous; Stannous Fluoride; Stannous Tartrate; Succimer; Succinic Acid; Sucrose; Sulfobutylether .Beta.-Cyclodextrin; Sulfuric Acid; Tartaric Acid; Tartaric Acid, Dl-; Tert-Butyl Alcohol; Tetrakis(2-Methoxyisobutylisocyanide)Copper(I) Tetrafluoroborate; Theophylline; Thimerosal; Threonine; Tin; Trisodium Citrate Dihydrate; Tromantadine; Tromethamine; Versetamide |
| Intravenous Bolus | Sodium Chloride |
| Intravesical | Alcohol, Dehydrated; Edetate Calcium Disodium; Hydrochloric Acid; Nitrogen; Polyoxyl 35 Castor Oil; Potassium Phosphate, Monobasic; Sodium Chloride; Sodium Hydroxide; Sodium Phosphate, Dibasic, Anhydrous; Sodium Phosphate, Monobasic, Anhydrous |
| Intravitreal | Calcium Chloride; Carboxymethylcellulose Sodium; Cellulose, Microcrystalline; Hyaluronate Sodium; Hydrochloric Acid; Magnesium Chloride; Magnesium Stearate; Polysorbate 80; Polyvinyl Alcohol; Potassium Chloride; Sodium Acetate; Sodium Bicarbonate; Sodium Carbonate; Sodium Chloride; Sodium Hydroxide; Sodium Phosphate, Dibasic, Heptahydrate; Sodium Phosphate, Monobasic, Monohydrate; Trisodium Citrate Dihydrate |
| Iontophoresis | Cetylpyridinium Chloride; Citric Acid; Edetate Disodium; Glycerin; Hydrochloric Acid; Methylparaben; Phenonip; Polacrilin; Polyvinyl Alcohol; Povidone Hydrogel; Sodium Bisulfite; Sodium Chloride; Sodium Citrate; Sodium Hydroxide; Sodium Metabisulfite; Sodium Phosphate, Monobasic |
| Irrigation | Acetic Acid; Activated Charcoal; Benzoic Acid; Hydrochloric Acid; Hypromelloses; Methylparaben; Nitrogen; Sodium Bisulfite; Sodium Citrate; Sodium Hydroxide; Sulfuric Acid |
| Intravenous - Subcutaneous | Acetic Acid; Alcohol; Benzyl Alcohol; Calcium Hydroxide; Chlorobutanol; Glycerin; Hydrochloric Acid; Lactose Monohydrate; Methylparaben; Nitrogen; Phenol; Phenol, Liquefied; Phosphoric Acid; Propylparaben; Sodium Acetate; Sodium Carbonate; Sodium Chloride; Sodium Hydroxide |

TABLE 27-continued

Routes of Adminsitration and Inactive Ingredients

| Route of Administration | Inactive Ingredient |
|---|---|
| Intravenous (Infusion) | 1,2-Dimyristoyl-Sn-Glycero-3-(Phospho-S-(1-Glycerol)); 1,2-Dimyristoyl-Sn-Glycero-3-Phosphocholine; Acetic Acid; Acetic Acid, Glacial; Activated Charcoal; Alanine; Albumin Human; Alcohol; Alcohol, Dehydrated; Ammonium Acetate; Anhydrous Citric Acid; Anhydrous Dextrose; Anhydrous Lactose; Anhydrous Trisodium Citrate; Arginine; Ascorbic Acid; Aspartic Acid; Benzenesulfonic Acid; Benzethonium Chloride; Benzoic Acid; Benzyl Alcohol; Brocrinat; Butylated Hydroxyanisole; Butylated Hydroxytoluene; Carbon Dioxide; Chlorobutanol; Citric Acid; Citric Acid Monohydrate; Citric Acid, Hydrous; Cysteine; Cysteine Hydrochloride; Deoxycholic Acid; Dextrose; Dextrose Solution; Diatrizoic Acid; Diethanolamine; Dimethyl Sulfoxide; Disodium Sulfosalicylate; Disofenin; Edetate Calcium Disodium; Edetate Disodium; Edetate Disodium Anhydrous; Edetate Sodium; Egg Phospholipids; Ethylenediamine; Fructose; Gelatin; Gentisic Acid Ethanolamide; Glycerin; Glycine; Histidine; Hydrochloric Acid; Hydrochloric Acid, Diluted; Hydroxide Ion; Hydroxypropyl-Bcyclodextrin; Isoleucine; Isotonic Sodium Chloride Solution; Lactic Acid; Lactic Acid, Dl-; Lactobionic Acid; Lactose; Lactose Monohydrate; Lactose, Hydrous; Leucine; Lysine; Lysine Acetate; Magnesium Chloride; Maleic Acid; Mannitol; Meglumine; Metacresol; Metaphosphoric Acid; Methanesulfonic Acid; Methionine; Methylparaben; Monothioglycerol; N,N-Dimethylacetamide; Nitric Acid; Nitrogen; Peg Vegetable Oil; Peg-40 Castor Oil; Peg-60 Castor Oil; Pentetate Calcium Trisodium; Phenol; Phenylalanine; Phospholipid; Phospholipid, Egg; Phosphoric Acid; Polyethylene Glycol 300; Polyethylene Glycol 400; Polyoxyl 35 Castor Oil; Polysorbate 20; Polysorbate 80; Potassium Chloride; Potassium Hydroxide; Potassium Metabisulfite; Potassium Phosphate, Dibasic; Potassium Phosphate, Monobasic; Povidones; Proline; Propylene Glycol; Propylparaben; Saccharin Sodium; Saccharin Sodium Anhydrous; Serine; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Cholesteryl Sulfate; Sodium Citrate; Sodium Desoxycholate; Sodium Dithionite; Sodium Formaldehyde Sulfoxylate; Sodium Gluconate; Sodium Hydroxide; Sodium Hypochlorite; Sodium Lactate; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Tartrate; Sorbitol; Sorbitol Solution; Soybean Oil; Stannous Chloride; Stannous Chloride Anhydrous; Sterile Water For Inhalation; Sucrose; Sulfobutylether .Beta.-Cyclodextrin; Sulfur Dioxide; Sulfuric Acid; Tartaric Acid; Tartaric Acid, Dl-; Tert-Butyl Alcohol; Tetrofosmin; Theophylline; Threonine; Trifluoroacetic Acid; Trisodium Citrate Dihydrate; Tromethamine; Tryptophan; Tyrosine; Valine |
| Any Delivery Route | Alcohol; Benzyl Alcohol; Citric Acid Monohydrate; Gelfoam Sponge; Hydrochloric Acid; Methylparaben; Poly(Dl-Lactic-Co-Glycolic Acid), (50:50; Poly(Dl-Lactic-Co-Glycolic Acid), Ethyl Ester Terminated, (50:50; Polyquaternium-7 (70/30 Acrylamide/Dadmac; Propylene Glycol; Propylparaben; Sodium Chloride; Sodium Citrate; Sodium Hydroxide; Sodium Lactate; Sodium Phosphate, Monobasic, Monohydrate |
| Nasal | Acetic Acid; Alcohol, Dehydrated; Allyl .Alpha.-Ionone; Anhydrous Dextrose; Anhydrous Trisodium Citrate; Benzalkonium Chloride; Benzethonium Chloride; Benzyl Alcohol; Butylated Hydroxyanisole; Butylated Hydroxytoluene; Caffeine; Carbon Dioxide; Carboxymethylcellulose Sodium; Cellulose, Microcrystalline; Chlorobutanol; Citric Acid; Citric Acid Monohydrate; Dextrose; Dichlorodifluoromethane; Dichlorotetrafluoroethane; Edetate Disodium; Glycerin; Glycerol Ester Of Hydrogenated Rosin; Hydrochloric Acid; Hypromellose 2910 (15000 Mpa · S); Methylcelluloses; Methylparaben; Nitrogen; Norflurane; Oleic Acid; Petrolatum, White; Phenylethyl Alcohol; Polyethylene Glycol 3350; Polyethylene Glycol 400; Polyoxyl 400 Stearate; Polysorbate 20; Polysorbate 80; Potassium Phosphate, Monobasic; Potassium Sorbate; Propylene Glycol; Propylparaben; Sodium Acetate; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Dihydrate; Sodium Phosphate, Dibasic, |

TABLE 27-continued

Routes of Adminsitration and Inactive Ingredients

| Route of Administration | Inactive Ingredient |
|---|---|
| | Dodecahydrate; Sodium Phosphate, Dibasic, Heptahydrate; Sodium Phosphate, Monobasic, Anhydrous; Sodium Phosphate, Monobasic, Dihydrate; Sorbitan Trioleate; Sorbitol; Sorbitol Solution; Sucralose; Sulfuric Acid; Trichloromonofluoromethane; Trisodium Citrate Dihydrate |
| Nerve Block | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium Chloride; Sodium Citrate; Sodium Hydroxide; Sodium Lactate; Sodium Lactate, L-; Sodium Metabisulfite; Sodium Phosphate; Sodium Phosphate, Dibasic, Heptahydrate |
| Ophthalmic | Acetic Acid; Alcohol; Alcohol, Dehydrated; Alginic Acid; Amerchol-Cab; Ammonium Hydroxide; Anhydrous Trisodium Citrate; Antipyrine; Benzalkonium Chloride; Benzethonium Chloride; Benzododecinium Bromide; Boric Acid; Caffeine; Calcium Chloride; Carbomer 1342; Carbomer 934p; Carbomer 940; Carbomer Homopolymer Type B (Allyl Pentaerythritol Crosslinked); Carboxymethylcellulose Sodium; Castor Oil; Cetyl Alcohol; Chlorobutanol; Chlorobutanol, Anhydrous; Cholesterol; Citric Acid; Citric Acid Monohydrate; Creatinine; Diethanolamine; Diethylhexyl Phthalate **See Cder Guidance: Limiting The Use Of Certain Phthalates As Excipients In Cder-Regulated Products; Divinylbenzene Styrene Copolymer; Edetate Disodium; Edetate Disodium Anhydrous; Edetate Sodium; Ethylene Vinyl Acetate Copolymer; Gellan Gum (Low Acyl); Glycerin; Glyceryl Stearate; High Density Polyethylene; Hydrocarbon Gel, Plasticized; Hydrochloric Acid; Hydrochloric Acid, Diluted; Hydroxyethyl Cellulose; Hydroxypropyl Methylcellulose 2906; Hypromellose 2910 (15000 Mpa · S); Hypromelloses; Jelene; Lanolin; Lanolin Alcohols; Lanolin Anhydrous; Lanolin Nonionic Derivatives; Lauralkonium Chloride; Lauroyl Sarcosine; Light Mineral Oil; Magnesium Chloride; Mannitol; Methylcellulose (4000 Mpa · S); Methylcelluloses; Methylparaben; Mineral Oil; Nitric Acid; Nitrogen; Nonoxynol-9; Octoxynol-40; Octylphenol Polymethylene; Petrolatum; Petrolatum, White; Phenylethyl Alcohol; Phenylmercuric Acetate; Phenylmercuric Nitrate; Phosphoric Acid; Polidronium Chloride; Poloxamer 188; Poloxamer 407; Polycarbophil; Polyethylene Glycol 300; Polyethylene Glycol 400; Polyethylene Glycol 8000; Polyoxyethylene - Polyoxypropylene 1800; Polyoxyl 35 Castor Oil; Polyoxyl 40 Hydrogenated Castor Oil; Polyoxyl 40 Stearate; Polypropylene Glycol; Polysorbate 20; Polysorbate 60; Polysorbate 80; Polyvinyl Alcohol; Potassium Acetate; Potassium Chloride; Potassium Phosphate, Monobasic; Potassium Sorbate; Povidone K29/32; Povidone K30; Povidone K90; Povidones; Propylene Glycol; Propylparaben; Soda Ash; Sodium Acetate; Sodium Bisulfate; Sodium Bisulfite; Sodium Borate; Sodium Borate Decahydrate; Sodium Carbonate; Sodium Carbonate Monohydrate; Sodium Chloride; Sodium Citrate; Sodium Hydroxide; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfate; Sodium Sulfate Anhydrous; Sodium Sulfate Decahydrate; Sodium Sulfite; Sodium Thiosulfate; Sorbic Acid; Sorbitan Monolaurate; Sorbitol; Sorbitol Solution; Stabilized Oxychloro Complex; Sulfuric Acid; Thimerosal; Titanium Dioxide; Tocophersolan; Trisodium Citrate Dihydrate; Triton 720; Tromethamine; Tyloxapol; Zinc Chloride |
| Parenteral | Hydrochloric Acid; Mannitol; Nitrogen; Sodium Acetate; Sodium Chloride; Sodium Hydroxide |
| Percutaneous | Duro-Tak 87-2287; Silicone Adhesive 4102 |
| Perfusion, Biliary | Glycerin |
| Perfusion, Cardiac | Hydrochloric Acid; Sodium Hydroxide |
| Periarticular | Diatrizoic Acid; Edetate Calcium Disodium; Iodine; Meglumine |
| Peridural | Citric Acid; Hydrochloric Acid; Methylparaben; Sodium Chloride; Sodium Hydroxide; Sodium Metabisulfite |
| Perineural | Hydrochloric Acid; Sodium Chloride; Sodium Hydroxide |
| Periodontal | Ethylene Vinyl Acetate Copolymer; Hydrochloric Acid; Methyl Pyrrolidone; Poloxamer 188; Poloxamer 407; Polylactide |

TABLE 27-continued

Routes of Adminsitration and Inactive Ingredients

| Route of Administration | Inactive Ingredient |
|---|---|
| Photopheresis | Acetic Acid; Alcohol, Dehydrated; Propylene Glycol; Sodium Acetate; Sodium Chloride; Sodium Hydroxide |
| Rectal | Alcohol; Alcohol, Dehydrated; Aluminum Subacetate; Anhydrous Citric Acid; Aniseed Oil; Ascorbic Acid; Ascorbyl Palmitate; Balsam Peru; Benzoic Acid; Benzyl Alcohol; Bismuth Subgallate; Butylated Hydroxyanisole; Butylated Hydroxytoluene; Butylparaben; Caramel; Carbomer 934; Carbomer 934p; Carboxypolymethylene; Cerasynt-Se; Cetyl Alcohol; Cocoa Butter; Coconut Oil, Hydrogenated; Coconut Oil/Palm Kernel Oil Glycerides, Hydrogenated; *Cola Nitida* Seed Extract; D&C Yellow No. 10; Dichlorodifluoromethane; Dichlorotetrafluoroethane; Dimethyldioctadecylammonium Bentonite; Edetate Calcium Disodium; Edetate Disodium; Edetic Acid; Epilactose; Ethylenediamine; Fat, Edible; Fat, Hard; Fd&C Blue No. 1; Fd&C Green No. 3; Fd&C Yellow No. 6; Flavor fig 827118; Flavor Raspberry Pfc-8407; Fructose; Galactose; Glycerin; Glyceryl Palmitate; Glyceryl Stearate; Glyceryl Stearate/Peg Stearate; Glyceryl Stearate/Peg-40 Stearate; Glycine; Hydrocarbon; Hydrochloric Acid; Hydrogenated Palm Oil; Hypromelloses; Lactose; Lanolin; Lecithin; Light Mineral Oil; Magnesium Aluminum Silicate; Magnesium Aluminum Silicate Hydrate; Methylparaben; Nitrogen; Palm Kernel Oil; Paraffin; Petrolatum, White; Polyethylene Glycol 1000; Polyethylene Glycol 1540; Polyethylene Glycol 3350; Polyethylene Glycol 400; Polyethylene Glycol 4000; Polyethylene Glycol 6000; Polyethylene Glycol 8000; Polysorbate 60; Polysorbate 80; Potassium Acetate; Potassium Metabisulfite; Propylene Glycol; Propylparaben; Saccharin Sodium; Saccharin Sodium Anhydrous; Silicon Dioxide, Colloidal; Simethicone; Sodium Benzoate; Sodium Carbonate; Sodium Chloride; Sodium Citrate; Sodium Hydroxide; Sodium Metabisulfite; Sorbitan Monooleate; Sorbitan Sesquioleate; Sorbitol; Sorbitol Solution; Starch; Steareth-10; Steareth-40; Sucrose; Tagatose, D-; Tartaric Acid, Dl-; Trolamine; Tromethamine; Vegetable Oil Glyceride, Hydrogenated; Vegetable Oil, Hydrogenated; Wax, Emulsifying; White Wax; Xanthan Gum; Zinc Oxide |
| Respiratory (Inhalation) | Alcohol; Alcohol, Dehydrated; Apaflurane; Benzalkonium Chloride; Calcium Carbonate; Edetate Disodium; Gelatin; Glycine; Hydrochloric Acid; Lactose Monohydrate; Lysine Monohydrate; Mannitol; Norflurane; Oleic Acid; Polyethylene Glycol 1000; Povidone K25; Silicon Dioxide, Colloidal; Sodium Chloride; Sodium Citrate; Sodium Hydroxide; Sodium Lauryl Sulfate; Sulfuric Acid; Titanium Dioxide; Tromethamine; Zinc Oxide |
| Retrobulbar | Hydrochloric Acid; Sodium Hydroxide |
| Soft Tissue | Acetic Acid; Anhydrous Trisodium Citrate; Benzyl Alcohol; Carboxymethylcellulose; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Heptahydrate; Sodium Phosphate, Monobasic; Sodium Phosphate, Monobasic, Anhydrous; Sodium Sulfite |
| Spinal | Anhydrous Dextrose; Dextrose; Hydrochloric Acid; Sodium Hydroxide |
| Subarachnoid | Hydrochloric Acid; Sodium Chloride; Sodium Hydroxide |
| Subconjunctival | Benzyl Alcohol; Hydrochloric Acid; Sodium Hydroxide |
| Subcutaneous | Acetic Acid; Acetic Acid, Glacial; Albumin Human; Ammonium Hydroxide; Ascorbic Acid; Benzyl Alcohol; Calcium Chloride; Carboxymethylcellulose Sodium; Chlorobutanol; Cresol; Diatrizoic Acid; Dimethyl Sulfoxide; Edetate Calcium Disodium; Edetate Disodium; Ethylene Vinyl Acetate Copolymer; Glycerin; Glycine; Glycine Hydrochloride; Histidine; Hydrochloric Acid; Lactic Acid; Lactic Acid, L-; Lactose; Magnesium Chloride; Magnesium Stearate; Mannitol; Metacresol; Methanesulfonic Acid; Methionine; Methyl Pyrrolidone; Methylparaben; Nitrogen; Phenol; Phenol, Liquefied; Phosphoric Acid; Poloxamer 188; Polyethylene Glycol 3350; Polyglactin; Polysorbate 20; Polysorbate 80; Potassium Phosphate, Dibasic; Potassium Phosphate, Monobasic; Povidone K17; Povidones; Propylene Glycol; Propylparaben; Protamine Sulfate; Sodium Acetate; Sodium Acetate Anhydrous; Sodium Bicarbonate; Sodium Bisulfite; Sodium Chloride; Sodium Citrate; Sodium Hydroxide; Sodium Metabisulfite; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, |

TABLE 27-continued

Routes of Adminsitration and Inactive Ingredients

| Route of Administration | Inactive Ingredient |
|---|---|
| | Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Thioglycolate; Stearic Acid; Sucrose; Thimerosal; Tromethamine; Zinc; Zinc Acetate; Zinc Carbonate; Zinc Chloride; Zinc Oxide |
| Sublingual | Alcohol, Dehydrated |
| Submucosal | Acetic Acid; Edetic Acid; Mannitol; Nitrogen; Sodium Acetate; Sodium Chloride; Sodium Hydroxide; Sodium Metabisulfite |
| Topical | .Alpha.-Terpineol; .Alpha.-Tocopherol; .Alpha.-Tocopherol Acetate, Dl-; .Alpha.-Tocopherol, Dl-; 1,2,6-Hexanetriol; 1-O-Tolylbiguanide; 2-Ethyl-1,6-Hexanediol; Acetic Acid; Acetone; Acetylated Lanolin Alcohols; Acrylates Copolymer; Adhesive Tape; Alcohol; Alcohol, Dehydrated; Alcohol, Denatured; Alcohol, Diluted; Alkyl Ammonium Sulfonic Acid Betaine; Alkyl Aryl Sodium Sulfonate; Allantoin; Almond Oil; Aluminum Acetate; Aluminum Chlorhydroxy Allantoinate; Aluminum Hydroxide; Aluminum Hydroxide - Sucrose, Hydrated; Aluminum Hydroxide Gel; Aluminum Hydroxide Gel F 500; Aluminum Hydroxide Gel F 5000; Aluminum Monostearate; Aluminum Oxide; Aluminum Silicate; Aluminum Starch Octenylsuccinate; Aluminum Stearate; Aluminum Sulfate Anhydrous; Amerchol C; Amerchol-Cab; Aminomethylpropanol; Ammonia Solution; Ammonia Solution, Strong; Ammonium Hydroxide; Ammonium Lauryl Sulfate; Ammonium Nonoxynol-4 Sulfate; Ammonium Salt Of C-12-C-15 Linear Primary Alcohol Ethoxylate; Ammonyx; Amphoteric-2; Amphoteric-9; Anhydrous Citric Acid; Anhydrous Trisodium Citrate; Anoxid Sbn; Antifoam; Apricot Kernel Oil Peg-6 Esters; Aquaphor; Arlacel; Ascorbic Acid; Ascorbyl Palmitate; Beeswax; Beeswax, Synthetic; Beheneth-10; Bentonite; Benzalkonium Chloride; Benzoic Acid; Benzyl Alcohol; Betadex; Boric Acid; Butane; Butyl Alcohol; Butyl Ester Of Vinyl Methyl Ether/Maleic Anhydride Copolymer (125000 Mw); Butyl Stearate; Butylated Hydroxyanisole; Butylated Hydroxytoluene; Butylene Glycol; Butylparaben; C20-40 Pareth-24; Calcium Chloride; Calcium Hydroxide; Canada Balsam; Caprylic/Capric Triglyceride; Caprylic/Capric/Stearic Triglyceride; Captan; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythritol Crosslinked); Carbomer Homopolymer Type C (Allyl Pentaerythritol Crosslinked); Carboxy Vinyl Copolymer; Carboxymethylcellulose; Carboxymethylcellulose Sodium; Carboxypolymethylene; Carrageenan; Carrageenan Salt; Castor Oil; Cedar Leaf Oil; Cellulose; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20; Ceteth-23; Cetostearyl Alcohol; Cetrimonium Chloride; Cetyl Alcohol; Cetyl Esters Wax; Cetyl Palmitate; Chlorobutanol; Chlorocresol; Chloroxylenol; Cholesterol; Choleth-24; Citric Acid; Citric Acid Monohydrate; Cocamide Ether Sulfate; Cocamine Oxide; Coco Betaine; Coco Diethanolamide; Coco Monoethanolamide; Cocoa Butter; Coco-Glycerides; Coconut Oil; Cocoyl Caprylocaprate; Collagen; Coloring Suspension; Cream Base; Creatinine; Crospovidone; Cyclomethicone; Cyclomethicone/Dimethicone Copolyol; D&C Red No. 28; D&C Red No. 33; D&C Red No. 36; D&C Red No. 39; D&C Yellow No. 10; Decyl Methyl Sulfoxide; Dehydag Wax Sx; Dehydroacetic Acid; Dehymuls E; Denatonium Benzoate; Dextrin; Diazolidinyl Urea; Dichlorobenzyl Alcohol; Dichlorodifluoromethane; Dichlorotetrafluoroethane; Diethanolamine; Diethyl Sebacate; Diethylene Glycol Monoethyl Ether; Dihydroxyaluminum Aminoacetate; Diisopropanolamine; Diisopropyl Adipate; Diisopropyl Dilinoleate; Dimethicone 350; Dimethicone Copolyol; Dimethicone Medical Fluid 360; Dimethyl Isosorbide; Dimethyl Sulfoxide; Dinoseb Ammonium Salt; Disodium Cocoamphodiacetate; Disodium Laureth Sulfosuccinate; Disodium Lauryl Sulfosuccinate; Dmdm Hydantoin; Docosanol; Docusate Sodium; Edetate Disodium; Edetate Sodium; Edetic Acid; Entsufon; Entsufon Sodium; Epitetracycline Hydrochloride; Essence Bouquet 9200; Ethyl Acetate; Ethylcelluloses; Ethylene Glycol; Ethylenediamine; Ethylenediamine Dihydrochloride; Ethylhexyl Hydroxystearate; Ethylparaben; Fatty Acid Pentaerythriol Ester; Fatty Acids; Fatty Alcohol Citrate; Fd&C Blue No. 1; Fd&C Red No. 4; Fd&C Red No. 40; Fd&C Yellow No. 10 (Delisted); Fd&C Yellow No. 5; Fd&C Yellow No. 6; Ferric Oxide; Flavor Rhodia Pharmaceutical No. Rf 451; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124; Fragrance Bouquet 10328; Fragrance Chemoderm 6401-B; Fragrance Chemoderm 6411; Fragrance Cream |

TABLE 27-continued

Routes of Adminsitration and Inactive Ingredients

| Route of Administration | Inactive Ingredient |
|---|---|
| | No. 73457; Fragrance Cs-28197; Fragrance Felton 066m; Fragrance Firmenich 47373; Fragrance Givaudan Ess 9090/1c; Fragrance H-6540; Fragrance Herbal 10396; Fragrance Nj-1085; Fragrance P O Fl-147; Fragrance Pa 52805; Fragrance Pera Derm D; Fragrance Rbd-9819; Fragrance Shaw Mudge U-7776; Fragrance Tf 044078; Fragrance Ungerer Honeysuckle K 2771; Fragrance Ungerer N5195; Gelatin; Gluconolactone; Glycerin; Glyceryl Citrate; Glyceryl Isostearate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate - Laureth-23; Glyceryl Stearate/Peg-100 Stearate; Glyceryl Stearate-Stearamidoethyl Diethylamine; Glycol Distearate; Glycol Stearate; Guar Gum; Hair Conditioner (18n195-1m); Hexylene Glycol; High Density Polyethylene; Hyaluronate Sodium; Hydrocarbon Gel, Plasticized; Hydrochloric Acid; Hydrochloric Acid, Diluted; Hydrogen Peroxide; Hydrogenated Castor Oil; Hydrogenated Palm/Palm Kernel Oil Peg-6 Esters; Hydroxyethyl Cellulose; Hydroxymethyl Cellulose; Hydroxyoctacosanyl Hydroxystearate; Hydroxypropyl Cellulose; Hypromelloses; Imidurea; Irish Moss Extract; Isobutane; Isoceteth-20; Isooctyl Acrylate; Isopropyl Alcohol; Isopropyl Isostearate; Isopropyl Myristate; Isopropyl Myristate - Myristyl Alcohol; Isopropyl Palmitate; Isopropyl Stearate; Isostearic Acid; Isostearyl Alcohol; Jelene; Kaolin; Kathon Cg; Kathon Cg Ii; Lactate; Lactic Acid; Lactic Acid, Dl-; Laneth; Lanolin; Lanolin Alcohol - Mineral Oil; Lanolin Alcohols; Lanolin Anhydrous; Lanolin Cholesterols; Lanolin, Ethoxylated; Lanolin, Hydrogenated; Lauramine Oxide; Laurdimonium Hydrolyzed Animal Collagen; Laureth Sulfate; Laureth-2; Laureth-23; Laureth-4; Lauric Diethanolamide; Lauric Myristic Diethanolamide; Lauryl Sulfate; *Lavandula Angustifolia* Flowering Top; Lecithin; Lecithin Unbleached; Lemon Oil; Light Mineral Oil; Light Mineral Oil (85 Ssu); Limonene, (+/−)-; Lipocol Sc-15; Magnesium Aluminum Silicate; Magnesium Aluminum Silicate Hydrate; Magnesium Nitrate; Magnesium Stearate; Mannitol; Maprofix; Medical Antiform A-F Emulsion; Menthol; Methyl Gluceth-10; Methyl Gluceth-20; Methyl Gluceth-20 Sesquistearate; Methyl Glucose Sesquistearate; Methyl Salicylate; Methyl Stearate; Methylcelluloses; Methylchloroisothiazolinone; Methylisothiazolinone; Methylparaben; Microcrystalline Wax; Mineral Oil; Mono And Diglyceride; Monostearyl Citrate; Multisterol Extract; Myristyl Alcohol; Myristyl Lactate; Niacinamide; Nitric Acid; Nitrogen; Nonoxynol Iodine; Nonoxynol-15; Nonoxynol-9; Oatmeal; Octadecene-1/Maleic Acid Copolymer; Octoxynol-1; Octoxynol-9; Octyldodecanol; Oleic Acid; Oleth-10/Oleth-5; Oleth-2; Oleth-20; Oleyl Alcohol; Oleyl Oleate; Olive Oil; Palmitamine Oxide; Parabens; Paraffin; Paraffin, White Soft; Parfum Creme 45/3; Peanut Oil; Peanut Oil, Refined; Pectin; Peg 6-32 Stearate/Glycol Stearate; Peg-100 Stearate; Peg-12 Glyceryl Laurate; Peg-120 Glyceryl Stearate; Peg-120 Methyl Glucose Dioleate; Peg-15 Cocamine; Peg-150 Distearate; Peg-2 Stearate; Peg-22 Methyl Ether/Dodecyl Glycol Copolymer; Peg-25 Propylene Glycol Stearate; Peg-4 Dilaurate; Peg-4 Laurate; Peg-45/Dodecyl Glycol Copolymer; Peg-5 Oleate; Peg-50 Stearate; Peg-54 Hydrogenated Castor Oil; Peg-6 Isostearate; Peg-60 Hydrogenated Castor Oil; Peg-7 Methyl Ether; Peg-75 Lanolin; Peg-8 Laurate; Peg-8 Stearate; Pegoxol 7 Stearate; Pentaerythritol Cocoate; Peppermint Oil; Perfume 25677; Perfume Bouquet; Perfume E-1991; Perfume Gd 5604; Perfume Tana 90/42 Scba; Perfume W-1952-1; Petrolatum; Petrolatum, White; Petroleum Distillates; Phenonip; Phenoxyethanol; Phenylmercuric Acetate; Phosphoric Acid; Pine Needle Oil (*Pinus Sylvestris*); Plastibase-50w; Polidronium Chloride; Poloxamer 124; Poloxamer 181; Poloxamer 182; Poloxamer 188; Poloxamer 237; Poloxamer 407; Polycarbophil; Polyethylene Glycol 1000; Polyethylene Glycol 1450; Polyethylene Glycol 1500; Polyethylene Glycol 1540; Polyethylene Glycol 200; Polyethylene Glycol 300; Polyethylene Glycol 300-1600; Polyethylene Glycol 3350; Polyethylene Glycol 400; Polyethylene Glycol 4000; Polyethylene Glycol 540; Polyethylene Glycol 600; Polyethylene Glycol 6000; Polyethylene Glycol 8000; Polyethylene Glycol 900; Polyhydroxyethyl Methacrylate; Polyisobutylene; Polyisobutylene (1100000 Mw); Polyoxyethylene - Polyoxypropylene 1800; Polyoxyethylene Alcohols; Polyoxyethylene Fatty Acid Esters; Polyoxyethylene Propylene; Polyoxyl 20 Cetostearyl Ether; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate; Polyoxyl Lanolin; Polyoxyl Stearate; Polypropylene; Polyquaternium-10; Polysorbate 20; Polysorbate 40; Polysorbate 60; Polysorbate 65; Polysorbate 80; Polyvinyl Alcohol; Potash; Potassium Citrate; Potassium Hydroxide; Potassium Soap; |

TABLE 27-continued

Routes of Adminsitration and Inactive Ingredients

| Route of Administration | Inactive Ingredient |
|---|---|
| | Potassium Sorbate; Povidone Acrylate Copolymer; Povidone Hydrogel; Povidone K90; Povidone/Eicosene Copolymer; Povidones; Ppg-12/Smdi Copolymer; Ppg-15 Stearyl Ether; Ppg-20 Methyl Glucose Ether Distearate; Ppg-26 Oleate; Product Wat; Promulgen D; Promulgen G; Propane; Propellant A-46; Propyl Gallate; Propylene Carbonate; Propylene Glycol; Propylene Glycol Diacetate; Propylene Glycol Dicaprylate; Propylene Glycol Monopalmitostearate; Propylene Glycol Palmitostearate; Propylene Glycol Ricinoleate; Propylene Glycol/Diazolidinyl Urea/Methylparaben/Propylparben; Propylparaben; Protein Hydrolysate; Quaternium-15; Quaternium-15 Cis-Form; Quaternium-52; Saccharin; Saccharin Sodium; Safflower Oil; Sd Alcohol 3a; Sd Alcohol 40; Sd Alcohol 40-2; Sd Alcohol 40b; Sepineo P 600; Shea Butter; Silicon; Silicon Dioxide; Silicone; Silicone Adhesive Bio-Psa Q7-4201; Silicone Adhesive Bio-Psa Q7-4301; Silicone Emulsion; Simethicone; Simethicone Emulsion; Sipon Ls 20np; Sodium Acetate; Sodium Acetate Anhydrous; Sodium Alkyl Sulfate; Sodium Benzoate; Sodium Bisulfite; Sodium Borate; Sodium Cetostearyl Sulfate; Sodium Chloride; Sodium Citrate; Sodium Cocoyl Sarcosinate; Sodium Dodecylbenzenesulfonate; Sodium Formaldehyde Sulfoxylate; Sodium Hydroxide; Sodium Iodide; Sodium Lactate; Sodium Laureth-2 Sulfate; Sodium Laureth-3 Sulfate; Sodium Laureth-5 Sulfate; Sodium Lauroyl Sarcosinate; Sodium Lauryl Sulfate; Sodium Lauryl Sulfoacetate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Polyacrylate (2500000 Mw); Sodium Pyrrolidone Carboxylate; Sodium Sulfite; Sodium Sulfosuccinated Undecyclenic Monoalkylolamide; Sodium Thiosulfate; Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Tristearate; Sorbitol; Sorbitol Solution; Soybean Flour; Soybean Oil; Spearmint Oil; Spermaceti; Squalane; Starch; Stearalkonium Chloride; Stearamidoethyl Diethylamine; Steareth-10; Steareth-100; Steareth-2; Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Styrene/Isoprene/Styrene Block Copolymer; Sucrose; Sucrose Distearate; Sucrose Polyesters; Sulfacetamide Sodium; Sulfuric Acid; Surfactol Qs; Talc; Tall Oil; Tallow Glycerides; Tartaric Acid; Tenox; Tenox-2; Tert-Butyl Alcohol; Tert-Butyl Hydroperoxide; Thimerosal; Titanium Dioxide; Tocopherol; Tocophersolan; Trichloromonofluoromethane; Trideceth-10; Triethanolamine Lauryl Sulfate; Triglycerides, Medium Chain; Trihydroxystearin; Trilaneth-4 Phosphate; Trilaureth-4 Phosphate; Trisodium Citrate Dihydrate; Trisodium Hedta; Triton X-200; Trolamine; Tromethamine; Tyloxapol; Undecylenic Acid; Vegetable Oil; Vegetable Oil, Hydrogenated; Viscarin; Vitamin E; Wax, Emulsifying; Wecobee Fs; White Wax; Xanthan Gum; Zinc Acetate |
| Transdermal | Acrylates Copolymer; Acrylic Acid-Isooctyl Acrylate Copolymer; Acrylic Adhesive 788; Adcote 72a103; Aerotex Resin 3730; Alcohol; Alcohol, Dehydrated; Aluminum Polyester; Bentonite; Butylated Hydroxytoluene; Butylene Glycol; Butyric Acid; Caprylic/Capric Triglyceride; Carbomer 1342; Carbomer 940; Carbomer 980; Carrageenan; Cetylpyridinium Chloride; Citric Acid; Crospovidone; Daubert 1-5 Pestr (Matte) 164z; Diethylene Glycol Monoethyl Ether; Diethylhexyl Phthalate **See Cder Guidance: Limiting The Use Of Certain Phthalates As Excipients In Cder-Regulated Products; Dimethicone Copolyol; Dimethicone Mdx4-4210; Dimethicone Medical Fluid 360; Dimethylaminoethyl Methacrylate - Butyl Methacrylate - Methyl Methacrylate Copolymer; Dipropylene Glycol; Duro-Tak 280-2516; Duro-Tak 387-2516; Duro-Tak 80-1196; Duro-Tak 87-2070; Duro-Tak 87-2194; Duro-Tak 87-2287; Duro-Tak 87-2296; Duro-Tak 87-2888; Duro-Tak 87-2979; Edetate Disodium; Ethyl Acetate; Ethyl Oleate; Ethylcelluloses; Ethylene Vinyl Acetate Copolymer; Ethylene-Propylene Copolymer; Fatty Acid Esters; Gelva 737; Glycerin; Glyceryl Laurate; Glyceryl Oleate; Heptane; High Density Polyethylene; Hydrochloric Acid; Hydrogenated Polybutene 635-690; Hydroxyethyl Cellulose; Hydroxypropyl Cellulose; Isopropyl Myristate; Isopropyl Palmitate; Lactose; Lanolin Anhydrous; Lauryl Lactate; Lecithin; Levulinic Acid; Light Mineral Oil; Medical Adhesive Modified S-15; Methyl Alcohol; Methyl Laurate; Mineral Oil; Nitrogen; Octisalate; Octyldodecanol; Oleic Acid; Oleyl Alcohol; Oleyl Oleate; |

TABLE 27-continued

Routes of Adminsitration and Inactive Ingredients

| Route of Administration | Inactive Ingredient |
|---|---|
| | Pentadecalactone; Petrolatum, White; Polacrilin; Polyacrylic Acid (250000 Mw); Polybutene (1400 Mw); Polyester; Polyester Polyamine Copolymer; Polyester Rayon; Polyethylene Terephthalates; Polyisobutylene; Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polypropylene; Polyvinyl Acetate; Polyvinyl Alcohol; Polyvinyl Chloride; Polyvinyl Chloride-Polyvinyl Acetate Copolymer; Polyvinylpyridine; Povidone K29/32; Povidones; Propylene Glycol; Propylene Glycol Monolaurate; Ra-2397; Ra-3011; Silicon; Silicon Dioxide, Colloidal; Silicone; Silicone Adhesive 4102; Silicone Adhesive 4502; Silicone Adhesive Bio-Psa Q7-4201; Silicone Adhesive Bio-Psa Q7-4301; Silicone/Polyester Film Strip; Sodium Chloride; Sodium Citrate; Sodium Hydroxide; Sorbitan Monooleate; Stearalkonium Hectorite/Propylene Carbonate; Titanium Dioxide; Triacetin; Trolamine; Tromethamine; Union 76 Amsco-Res 6038; Viscose/Cotton |
| Transmucosal | Magnesium Stearate; Mannitol; Potassium Bicarbonate; Sodium Starch Glycolate |
| Ureteral | Benzyl Alcohol; Diatrizoic Acid; Edetate Calcium Disodium; Edetate Disodium; Hydrochloric Acid; Meglumine; Methylparaben; Propylparaben; Sodium Citrate; Sodium Hydroxide |
| Urethral | Diatrizoic Acid; Edetate Calcium Disodium; Edetate Disodium; Hydrochloric Acid; Meglumine; Methylparaben; Polyethylene Glycol 1450; Propylparaben; Sodium Hydroxide; Sodium Phosphate, Dibasic, Heptahydrate; Tromethamine |
| Vaginal | Adipic Acid; Alcohol, Denatured; Allantoin; Anhydrous Lactose; Apricot Kernel Oil Peg-6 Esters; Barium Sulfate; Beeswax; Bentonite; Benzoic Acid; Benzyl Alcohol; Butylated Hydroxyanisole; Butylated Hydroxytoluene; Calcium Lactate; Carbomer 934; Carbomer 934p; Cellulose, Microcrystalline; Ceteth-20; Cetostearyl Alcohol; Cetyl Alcohol; Cetyl Esters Wax; Cetyl Palmitate; Cholesterol; Choleth; Citric Acid; Citric Acid Monohydrate; Coconut Oil/Palm Kernel Oil Glycerides, Hydrogenated; Crospovidone; Edetate Disodium; Ethylcelluloses; Ethylene-Vinyl Acetate Copolymer (28% Vinyl Acetate); Ethylene-Vinyl Acetate Copolymer (9% Vinylacetate); Fatty Alcohols; Fd&C Yellow No. 5; Gelatin; Glutamic Acid, Dl-; Glycerin; Glyceryl Isostearate; Glyceryl Monostearate; Glyceryl Stearate; Guar Gum; High Density Polyethylene; Hydrogel Polymer; Hydrogenated Palm Oil; Hypromellose 2208 (15000 Mpa · S); Hypromelloses; Isopropyl Myristate; Lactic Acid; Lactic Acid, Dl-; Lactose; Lactose Monohydrate; Lactose, Hydrous; Lanolin; Lanolin Anhydrous; Lecithin; Lecithin, Soybean; Light Mineral Oil; Magnesium Aluminum Silicate; Magnesium Aluminum Silicate Hydrate; Magnesium Stearate; Methyl Stearate; Methylparaben; Microcrystalline Wax; Mineral Oil; Nitric Acid; Octyldodecanol; Peanut Oil; Peg 6-32 Stearate/Glycol Stearate; Peg-100 Stearate; Peg-120 Glyceryl Stearate; Peg-2 Stearate; Peg-5 Oleate; Pegoxol 7 Stearate; Petrolatum, White; Phenylmercuric Acetate; Phospholipon 90g; Phosphoric Acid; Piperazine Hexahydrate; Poly(Dimethylsiloxane/Methylvinylsiloxane/Methylhydrogensiloxane) Dimethylvinyl Or Dimethylhydroxy Or Trimethyl Endblocked; Polycarbophil; Polyester; Polyethylene Glycol 1000; Polyethylene Glycol 3350; Polyethylene Glycol 400; Polyethylene Glycol 4000; Polyethylene Glycol 6000; Polyethylene Glycol 8000; Polyglyceryl-3 Oleate; Polyglyceryl-4 Oleate; Polyoxyl Palmitate; Polysorbate 20; Polysorbate 60; Polysorbate 80; Polyurethane; Potassium Alum; Potassium Hydroxide; Povidone K29/32; Povidones; Promulgen D; Propylene Glycol; Propylene Glycol Monopalmitostearate; Propylparaben; Quaternium-15 Cis-Form; Silicon Dioxide; Silicon Dioxide, Colloidal; Silicone; Sodium Bicarbonate; Sodium Citrate; Sodium Hydroxide; Sodium Lauryl Sulfate; Sodium Metabisulfite; Sodium Phosphate, Dibasic, Anhydrous; Sodium Phosphate, Monobasic, Anhydrous; Sorbic Acid; Sorbitan Monostearate; Sorbitol; Sorbitol Solution; Spermaceti; Stannous 2-Ethylhexanoate; Starch; Starch 1500, Pregelatinized; Starch, Corn; Stearamidoethyl Diethylamine; Stearic Acid; Stearyl Alcohol; Tartaric Acid, Dl-; Tert-Butylhydroquinone; Tetrapropyl Orthosilicate; Trolamine; Urea; Vegetable Oil, Hydrogenated; Wecobee Fs; White Ceresin Wax; White Wax |

Non-limiting routes of administration for the NAVs of the present invention are described below.

Parenteral and Injectable Administration

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration may comprise at least one inactive ingredient. Any or none of the inactive ingredients used may have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation may also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

Injectable formulations may be for direct injection into a region of a tissue, organ and/or subject. As a non-limiting example, a tissue, organ and/or subject may be directly injected a formulation by intramyocardial injection into the ischemic region. (See e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions which are compatible with body tissues.

Rectal and Vaginal Administration

Compositions for rectal or vaginal (e.g., transvaginal) administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

As a non-limiting example, the formulations for rectal and/or vaginal administration may be prepared by mixing the drug with a suitable non-irritating excipient that is solid at ordinary temperatures but liquid at the rectal temperature and will therefore melt in the rectum and/or vagina to release the drug. Such materials include cocoa butter and polyethylene glycols.

A pharmaceutical composition for rectal administration may comprise at least one inactive ingredient. Any or none of the inactive ingredients used may have been approved by the US Food and Drug Administration (FDA). A non-exhaustive list of inactive ingredients for use in pharmaceutical compositions for rectal administration includes alcohol, alcohol, dehydrated, aluminum subacetate, anhydrous citric acid, aniseed oil, ascorbic acid, ascorbyl palmitate, balsam peru, benzoic acid, benzyl alcohol, bismuth subgallate, butylated hydroxyanisole, butylated hydroxytoluene, butylparaben, caramel, carbomer 934, carbomer 934p, carboxypolymethylene, cerasynt-se, cetyl alcohol, cocoa butter, coconut oil, hydrogenated, coconut oil/palm kernel oil glycerides, hydrogenated, cola nitida seed extract, d&c yellow no. 10, dichlorodifluoromethane, dichlorotetrafluoroethane, dimethyldioctadecylammonium bentonite, edetate calcium disodium, edetate disodium, edetic acid, epilactose, ethylenediamine, fat, edible, fat, hard, fd&c blue no. 1, fd&c green no. 3, fd&c yellow no. 6, flavor fig 827118, flavor raspberry pfc-8407, fructose, galactose, glycerin, glyceryl palmitate, glyceryl stearate, glyceryl stearate/peg stearate, glyceryl stearate/peg-40 stearate, glycine, hydrocarbon, hydrochloric acid, hydrogenated palm oil, hypromelloses, lactose, lanolin, lecithin, light mineral oil, magnesium aluminum silicate, magnesium aluminum silicate hydrate, methylparaben, nitrogen, palm kernel oil, paraffin, petrolatum, white, polyethylene glycol 1000, polyethylene glycol 1540, polyethylene glycol 3350, polyethylene glycol 400, polyethylene glycol 4000, polyethylene glycol 6000, polyethylene glycol 8000, polysorbate 60, polysorbate 80, potassium acetate, potassium metabisulfite, propylene glycol, propylparaben, saccharin sodium, saccharin sodium anhydrous, silicon dioxide, colloidal, simethicone, sodium benzoate, sodium carbonate, sodium chloride, sodium citrate, sodium hydroxide, sodium metabisulfite, sorbitan monooleate, sorbitan sesquioleate, sorbitol, sorbitol solution, starch, steareth-10, steareth-40, sucrose, tagatose, d-, tartaric acid, dl-, trolamine, tromethamine, vegetable oil glyceride, hydrogenated, vegetable oil, hydrogenated, wax, emulsifying, white wax, xanthan gum and zinc oxide.

A pharmaceutical composition for vaginal administration may comprise at least one inactive ingredient. Any or none of the inactive ingredients used may have been approved by the US Food and Drug Administration (FDA). A non-exhaustive list of inactive ingredients for use in pharmaceutical compositions for vaginal administration includes adipic acid, alcohol, denatured, allantoin, anhydrous lactose, apricot kernel oil peg-6 esters, barium sulfate, beeswax, bentonite, benzoic acid, benzyl alcohol, butylated hydroxyanisole, butylated hydroxytoluene, calcium lactate, carbomer 934, carbomer 934p, cellulose, microcrystalline, ceteth-20, cetostearyl alcohol, cetyl alcohol, cetyl esters wax, cetyl palmitate, cholesterol, choleth, citric acid, citric acid monohydrate, coconut oil/palm kernel oil glycerides, hydrogenated, crospovidone, edetate disodium, ethylcelluloses, ethylene-vinyl acetate copolymer (28% vinyl acetate), ethylene-vinyl acetate copolymer (9% vinylacetate), fatty alcohols, fd&c yellow no. 5, gelatin, glutamic acid, dl-, glycerin, glyceryl isostearate, glyceryl monostearate, glyceryl stearate, guar gum, high density polyethylene, hydrogel polymer, hydrogenated palm oil, hypromellose 2208 (15000 mpa·s), hypromelloses, isopropyl myristate, lactic acid, lactic acid, dl-, lactose, lactose monohydrate, lactose, hydrous, lanolin, lanolin anhydrous, lecithin, lecithin, soybean, light mineral oil, magnesium aluminum silicate, magnesium aluminum silicate hydrate, magnesium stearate, methyl stearate, methylparaben, microcrystalline wax, mineral oil, nitric acid, octyldodecanol, peanut oil, peg 6-32 stearate/glycol stearate, peg-100 stearate, peg-120 glyceryl stearate, peg-2 stearate, peg-5 oleate, pegoxol 7 stearate, petrolatum, white, phenylmercuric acetate, phospholipon 90 g, phosphoric acid, piperazine hexahydrate, poly(dimethylsiloxane/methylvinylsiloxane/methylhydrogensiloxane) dimethylvinyl or dimethylhydroxy or trimethyl endblocked, polycarbophil, polyester, polyethylene glycol 1000, polyethylene glycol 3350, polyethylene glycol 400, polyethylene glycol 4000, polyethylene glycol 6000, polyethylene glycol 8000, polyglyceryl-3 oleate, polyglyceryl-4 oleate, polyoxyl palmitate, polysorbate 20, polysorbate 60, polysorbate 80, polyurethane, potassium alum, potassium hydroxide, povidone k29/32, povidones, promulgen d, propylene glycol, propylene glycol monopalmitostearate, propylparaben, quaternium-15 cis-form, silicon dioxide, silicon dioxide, colloidal, silicone, sodium bicarbonate, sodium citrate, sodium hydroxide, sodium lauryl sulfate, sodium metabisulfite, sodium phosphate, dibasic, anhydrous, sodium phosphate, monobasic, anhydrous, sorbic acid, sorbitan monostearate, sorbitol, sorbitol solution, spermaceti, stannous 2-ethylhexanoate, starch, starch 1500, pregelatinized, starch, corn, stearamidoethyl diethylamine, stearic acid, stearyl alcohol, tartaric acid, dl-, tert-butylhydroquinone, tetrapropyl orthosilicate, trolamine, urea, vegetable oil, hydrogenated, wecobee fs, white ceresin wax and white wax.

Oral Administration

Liquid dosage forms for oral administration include, but are not limited to, pharmaceutically acceptable emulsions, microemulsions, solutions, suspensions, syrups, and/or elixirs. In addition to active ingredients, liquid dosage forms may comprise inert diluents and/or excipients commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

Suspensions for oral dosage may contain the active materials in a mixture with excipients suitable for the manufacture of aqueous suspensions. Such excipients may be suspending agents, as a non-limiting example the suspending agents may be sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate; or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions may also contain one or more preservatives, for example ethyl, or n-propyl p-hydroxybenzoate, one or more coloring agents, one or more flavoring agents, and one or more sweetening agents, such as sucrose or saccharin.

Oily suspensions for oral dosage can be formulated by suspending the active ingredients in a vegetable oil, for example *arachis* oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid The oral dosage may also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions may also contain sweetening and flavoring agents.

Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents. The solid dosage forms may also dissolve once they come in contact with liquid such as, but not limited to, salvia and bile.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations.

Solid dosage forms may be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Dosage forms for oral delivery may also be chewable or may be suckable (e.g., lozenge form). The chewable dosages forms may be sustained release formulations such as, but not limited to, the sustained release compositions described in International Publication No WO2013082470 and US Publication No US20130142876, each of which is herein incorporated by reference in its entirety. The chewable dosage forms may comprise amphipathic lipids such as, but not limited to, those described in International Publication No WO2013082470 and US Publication No US20130142876, each of which is herein incorporated by reference in its entirety.

Topical or Transdermal Administration

As described herein, compositions containing the NAVs of the invention may be formulated for administration transdermally. The skin may be an ideal target site for delivery as it is readily accessible. Gene expression may be restricted not only to the skin, potentially avoiding nonspecific toxicity, but also to specific layers and cell types within the skin.

The site of cutaneous expression of the delivered compositions will depend on the route of nucleic acid delivery. Two routes are commonly considered to deliver NAVs to the skin: (ii) intradermal injection; and (iii) systemic delivery (e.g. for treatment of dermatologic diseases that affect both cutaneous and extracutaneous regions). NAVs can be delivered to the skin by several different approaches known in the art. After delivery of the nucleic acid, gene products have been detected in a number of different skin cell types, including, but not limited to, basal keratinocytes, sebaceous gland cells, dermal fibroblasts and dermal macrophages.

In one embodiment, the invention provides for the NAV compositions to be delivered in more than one injection.

In one embodiment, before transdermal administration at least one area of tissue, such as skin, may be subjected to a device and/or solution which may increase permeability. In one embodiment, the tissue may be subjected to an abrasion device to increase the permeability of the skin (see U.S. Patent Publication No. 20080275468, herein incorporated by reference in its entirety). In another embodiment, the tissue may be subjected to an ultrasound enhancement device. An ultrasound enhancement device may include, but is not limited to, the devices described in U.S. Publication No. 20040236268 and U.S. Pat. Nos. 6,491,657 and 6,234,990; each of which are herein incorporated by reference in their entireties. Methods of enhancing the permeability of tissue are described in U.S. Publication Nos. 20040171980 and 20040236268 and U.S. Pat. No. 6,190,315; each of which are herein incorporated by reference in their entireties.

In one embodiment, a device may be used to increase permeability of tissue before delivering formulations of modified mRNA described herein. The permeability of skin may be measured by methods known in the art and/or described in U.S. Pat. No. 6,190,315, herein incorporated by reference in its entirety. As a non-limiting example, a modified mRNA formulation may be delivered by the drug delivery methods described in U.S. Pat. No. 6,190,315, herein incorporated by reference in its entirety.

In another non-limiting example tissue may be treated with a eutectic mixture of local anesthetics (EMLA) cream before, during and/or after the tissue may be subjected to a device which may increase permeability. Katz et al. (Anesth Analg (2004); 98:371-76; herein incorporated by reference in its entirety) showed that using the EMLA cream in combination with a low energy, an onset of superficial cutaneous analgesia was seen as fast as 5 minutes after a pretreatment with a low energy ultrasound.

In one embodiment, enhancers may be applied to the tissue before, during, and/or after the tissue has been treated to increase permeability. Enhancers include, but are not limited to, transport enhancers, physical enhancers, and cavitation enhancers. Non-limiting examples of enhancers are described in U.S. Pat. No. 6,190,315, herein incorporated by reference in its entirety.

In one embodiment, a device may be used to increase permeability of tissue before delivering formulations of NAVs described herein, which may further contain a substance that invokes an immune response. In another non-limiting example, a formulation containing a substance to invoke an immune response may be delivered by the methods described in U.S. Publication Nos. 20040171980 and 20040236268; each of which are herein incorporated by reference in their entireties.

Dosage forms for transdermal administration of a composition may include ointments, pastes, creams, lotions, gels, powders, solutions, sprays, inhalants and/or patches. Generally, an active ingredient is admixed under sterile conditions with a pharmaceutically acceptable excipient and/or any needed preservatives and/or buffers as may be required.

Additionally, the present invention contemplates the use of transdermal patches, which often have the added advantage of providing controlled delivery of a compound to the body. Such dosage forms may be prepared, for example, by dissolving and/or dispensing the compound in the proper medium. Alternatively or additionally, rate may be controlled by either providing a rate controlling membrane and/or by dispersing the compound in a polymer matrix and/or gel.

A pharmaceutical NAV composition for transdermal administration may comprise at least one inactive ingredient. Any or none of the inactive ingredients used may have been approved by the US Food and Drug Administration (FDA). A non-exhaustive list of inactive ingredients for use in pharmaceutical compositions for transdermal administration includes acrylates copolymer, acrylic acid-isooctyl acrylate copolymer, acrylic adhesive 788, adcote 72a103, aerotex resin 3730, alcohol, alcohol, dehydrated, aluminum polyester, bentonite, butylated hydroxytoluene, butylene glycol, butyric acid, caprylic/capric triglyceride, carbomer 1342, carbomer 940, carbomer 980, carrageenan, cetylpyridinium chloride, citric acid, crospovidone, daubert 1-5 pestr (matte) 164z, diethylene glycol monoethyl ether, diethylhexyl phthalate, dimethicone copolyol, dimethicone mdx4-4210, dimethicone medical fluid 360, dimethylaminoethyl methacrylate-butyl methacrylate-methyl methacrylate copolymer, dipropylene glycol, duro-tak 280-2516, duro-tak 387-2516, duro-tak 80-1196, duro-tak 87-2070, duro-tak 87-2194, duro-tak 87-2287, duro-tak 87-2296, duro-tak 87-2888, duro-tak 87-2979, edetate disodium, ethyl acetate, ethyl oleate, ethylcelluloses, ethylene vinyl acetate copolymer, ethylene-propylene copolymer, fatty acid esters, gelva 737, glycerin, glyceryl laurate, glyceryl oleate, heptane, high density polyethylene, hydrochloric acid, hydrogenated polybutene 635-690, hydroxyethyl cellulose, hydroxypropyl cellulose, isopropyl myristate, isopropyl palmitate, lactose, lanolin anhydrous, lauryl lactate, lecithin, levulinic acid, light mineral oil, medical adhesive modified s-15, methyl alcohol, methyl laurate, mineral oil, nitrogen, octisalate, octyldodecanol, oleic acid, oleyl alcohol, oleyl oleate, pentadecalactone, petrolatum, white, polacrilin, polyacrylic acid (250000 mw), polybutene (1400 mw), polyester, polyester polyamine copolymer, polyester rayon, polyethylene terephthalates, polyisobutylene, polyisobutylene (1100000 mw), polyisobutylene (35000 mw), polyisobutylene 178-236, polyisobutylene 241-294, polyisobutylene 35-39, polyisobutylene low molecular weight, polyisobutylene medium molecular weight, polyisobutylene/polybutene adhesive, polypropylene, polyvinyl acetate, polyvinyl alcohol, polyvinyl chloride, polyvinyl chloride-polyvinyl acetate copolymer, polyvinylpyridine, povidone k29/32, povidones, propylene glycol, propylene glycol monolaurate, ra-2397, ra-3011, silicon, silicon dioxide, colloidal, silicone, silicone adhesive 4102, silicone adhesive 4502, silicone adhesive bio-psa q7-4201, silicone adhesive bio-psa q7-4301, silicone/polyester film strip, sodium chloride, sodium citrate, sodium hydroxide, sorbitan monooleate, stearalkonium hectorite/propylene carbonate, titanium dioxide, triacetin, trolamine, tromethamine, union 76 amsco-res 6038 and viscose/cotton.

A pharmaceutical NAV composition for intradermal administration may comprise at least one inactive ingredient. Any or none of the inactive ingredients used may have been approved by the US Food and Drug Administration (FDA). A non-exhaustive list of inactive ingredients for use in pharmaceutical compositions for intradermal administration includes benzalkonium chloride, benzyl alcohol, carboxymethylcellulose sodium, creatinine, edetate disodium, glycerin, hydrochloric acid, metacresol, methylparaben, phenol, polysorbate 80, protamine sulfate, sodium acetate, sodium bisulfite, sodium chloride, sodium hydroxide, sodium phosphate, sodium phosphate, dibasic, sodium phosphate, dibasic, heptahydrate, sodium phosphate, monobasic, anhydrous and zinc chloride.

Depot Administration

As described herein, in some embodiments, the composition is formulated in depots for extended release. Generally, a specific organ or tissue (a "target tissue") is targeted for administration.

In some aspects of the invention, the NAVs are spatially retained within or proximal to a target tissue. Provided are method of providing a composition to a target tissue of a mammalian subject by contacting the target tissue (which contains one or more target cells) with the composition under conditions such that the composition, in particular the nucleic acid component(s) of the composition, is substantially retained in the target tissue, meaning that at least 10, 20, 30, 40, 50, 60, 70, 80, 85, 90, 95, 96, 97, 98, 99, 99.9, 99.99 or greater than 99.99% of the composition is retained in the target tissue. Advantageously, retention is determined by measuring the amount of the nucleic acid present in the composition that enters one or more target cells. For example, at least 1, 5, 10, 20, 30, 40, 50, 60, 70, 80, 85, 90, 95, 96, 97, 98, 99, 99.9, 99.99 or greater than 99.99% of the nucleic acids administered to the subject are present intracellularly at a period of time following administration. For example, intramuscular injection to a mammalian subject is performed using an aqueous composition containing a ribonucleic acid and a transfection reagent, and retention of the composition is determined by measuring the amount of the ribonucleic acid present in the muscle cells.

Aspects of the invention are directed to methods of providing a composition to a target tissue of a mammalian subject, by contacting the target tissue (containing one or more target cells) with the composition under conditions such that the composition is substantially retained in the target tissue. The composition contains an effective amount of a polynucleotides such that the polypeptide of interest is produced in at least one target cell. The compositions generally contain a cell penetration agent, although "naked" NAV (such as nucleic acids without a cell penetration agent or other agent) is also contemplated, and a pharmaceutically acceptable carrier.

In some circumstances, the amount of a protein produced by cells in a tissue is desirably increased. Preferably, this increase in protein production is spatially restricted to cells within the target tissue. Thus, provided are methods of increasing production of a protein of interest in a tissue of a mammalian subject. A composition is provided that contains polynucleotides characterized in that a unit quantity of composition has been determined to produce the polypeptide of interest in a substantial percentage of cells contained within a predetermined volume of the target tissue.

In some embodiments, the NAV composition includes a plurality of different polynucleotides, where one or more than one of the polynucleotides encodes a polypeptide of interest. Optionally, the composition also contains a cell penetration agent to assist in the intracellular delivery of the composition. A determination is made of the dose of the composition required to produce the polypeptide of interest in a substantial percentage of cells contained within the predetermined volume of the target tissue (generally, without inducing significant production of the polypeptide of interest in tissue adjacent to the predetermined volume, or distally to the target tissue). Subsequent to this determination, the determined dose is introduced directly into the tissue of the mammalian subject.

In one embodiment, the invention provides for the NAVs to be delivered in more than one injection or by split dose injections.

In one embodiment, the invention may be retained near target tissue using a small disposable drug reservoir, patch pump or osmotic pump. Non-limiting examples of patch pumps include those manufactured and/or sold by BD® (Franklin Lakes, N.J.), Insulet Corporation (Bedford, Mass.), SteadyMed Therapeutics (San Francisco, Calif.), Medtronic (Minneapolis, Minn.) (e.g., MiniMed), UniLife (York, Pa.), Valeritas (Bridgewater, N.J.), and SpringLeaf Therapeutics (Boston, Mass.). A non-limiting example of an osmotic pump include those manufactured by DURECT® (Cupertino, Calif.) (e.g., DUROS® and ALZET®)).

Pulmonary Administration

A pharmaceutical composition may be prepared, packaged, and/or sold in a formulation suitable for pulmonary administration via the buccal cavity. Such a formulation may comprise dry particles which comprise the active ingredient and which have a diameter in the range from about 0.5 nm to about 7 nm or from about 1 nm to about 6 nm. Such compositions are suitably in the form of dry powders for administration using a device comprising a dry powder reservoir to which a stream of propellant may be directed to disperse the powder and/or using a self propelling solvent/powder dispensing container such as a device comprising the active ingredient dissolved and/or suspended in a low-boiling propellant in a sealed container. Such powders comprise particles wherein at least 98% of the particles by weight have a diameter greater than 0.5 nm and at least 95% of the particles by number have a diameter less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally the propellant may constitute 50% to 99.9% (w/w) of the composition, and active ingredient may constitute 0.1% to 20% (w/w) of the composition. A propellant may further comprise additional ingredients such as a liquid non-ionic and/or solid anionic surfactant and/or a solid diluent (which may have a particle size of the same order as particles comprising the active ingredient).

As a non-limiting example, the NAVs described herein may be formulated for pulmonary delivery by the methods described in U.S. Pat. No. 8,257,685; herein incorporated by reference in its entirety.

Pharmaceutical NAV compositions formulated for pulmonary delivery may provide an active ingredient in the form of droplets of a solution and/or suspension. Such formulations may be prepared, packaged, and/or sold as aqueous and/or dilute alcoholic solutions and/or suspensions, optionally sterile, comprising active ingredient, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

The compositions and formulations provided herein which may be used for pulmonary delivery may further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly(vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

Intranasal, Nasal and Buccal Administration

Formulations described herein as being useful for pulmonary delivery are useful for intranasal delivery of a NAV pharmaceutical composition. Another formulation suitable for intranasal administration is a coarse powder comprising the active ingredient and having an average particle from about 0.2 μm to 500 μm. Such a formulation is administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

A pharmaceutical NAV composition for inhalation (respiratory) administration may comprise at least one inactive ingredient. Any or none of the inactive ingredients used may have been approved by the US Food and Drug Administration (FDA). A non-exhaustive list of inactive ingredients for use in pharmaceutical compositions for inhalation (respiratory) administration includes acetone sodium bisulfite, acetylcysteine, alcohol, alcohol, dehydrated, ammonia, apaflurane, ascorbic acid, benzalkonium chloride, calcium carbonate, carbon dioxide, cetylpyridinium chloride, chlorobutanol, citric acid, d&c yellow no. 10, dichlorodifluoromethane, dichlorotetrafluoroethane, edetate disodium, edetate sodium, fd&c yellow no. 6, fluorochlorohydrocarbons, gelatin, glycerin, glycine, hydrochloric acid, hydrochloric acid, diluted, lactose, lactose monohydrate, lecithin, lecithin, hydrogenated soy, lecithin, soybean, lysine monohydrate, mannitol, menthol, methylparaben, nitric acid, nitrogen, norflurane, oleic acid, polyethylene glycol 1000, povidone k25, propylene glycol, propylparaben, saccharin, saccharin sodium, silicon dioxide, colloidal, sodium bisulfate, sodium bisulfite, sodium chloride, sodium citrate, sodium hydroxide, sodium lauryl sulfate, sodium metabisulfite, sodium sulfate anhydrous, sodium sulfite, sorbitan trioleate, sulfuric acid, thymol, titanium dioxide, trichloromonofluoromethane, tromethamine and zinc oxide.

A pharmaceutical NAV composition for nasal administration may comprise at least one inactive ingredient. Any or none of the inactive ingredients used may have been approved by the US Food and Drug Administration (FDA). A non-exhaustive list of inactive ingredients for use in pharmaceutical compositions for nasal administration includes acetic acid, alcohol, dehydrated, allyl.alpha.-ionone, anhydrous dextrose, anhydrous trisodium citrate, benzalkonium chloride, benzethonium chloride, benzyl alcohol, butylated hydroxyanisole, butylated hydroxytoluene, caffeine, carbon dioxide, carboxymethylcellulose sodium, cellulose, microcrystalline, chlorobutanol, citric acid, citric acid monohydrate, dextrose, dichlorodifluoromethane, dichlorotetrafluoroethane, edetate disodium, glycerin, glycerol ester of hydrogenated rosin, hydrochloric acid, hypromellose 2910 (15000 mpa·s), methylcelluloses, methylparaben, nitrogen, norflurane, oleic acid, petrolatum, white, phenylethyl alcohol, polyethylene glycol 3350, polyethylene glycol 400, polyoxyl 400 stearate, polysorbate 20, polysorbate 80, potassium phosphate, monobasic, potassium sorbate, propylene glycol, propylparaben, sodium acetate, sodium chloride, sodium citrate, sodium hydroxide, sodium phosphate, sodium phosphate, dibasic, sodium phosphate, dibasic, anhydrous, sodium phosphate, dibasic, dihydrate, sodium phosphate, dibasic, dodecahydrate, sodium phosphate, dibasic, heptahydrate, sodium phosphate, monobasic, anhydrous, sodium phosphate, monobasic, dihydrate, sorbitan trioleate, sorbitol, sorbitol solution, sucralose, sulfuric acid, trichloromonofluoromethane and trisodium citrate dihydrate.

Ophthalmic and Auricular (Otic) Administration

A pharmaceutical NAV composition may be prepared, packaged, and/or sold in a formulation suitable for delivery to and/or around the eye and/or delivery to the ear (e.g., auricular (otic) administration). Non-limiting examples of route of administration for delivery to and/or around the eye include retrobulbar, conjuctival, intracorneal, intraocular, intravitreal, ophthlamic and subconjuctiva. Such formulations may, for example, be in the form of eye drops or ear drops including, for example, a 0.1/1.0% (w/w) solution and/or suspension of the active ingredient in an aqueous or oily liquid excipient. Such drops may further comprise buffering agents, salts, and/or one or more other of any additional ingredients described herein. Other ophthalmically-administrable formulations which are useful include those which comprise the active ingredient in microcrystalline form and/or in a liposomal preparation. Ear drops and/or eye drops are contemplated as being within the scope of this invention. A multilayer thin film device may be prepared to contain a pharmaceutical composition for delivery to the eye and/or surrounding tissue.

A pharmaceutical NAV composition for ophthalmic administration may comprise at least one inactive ingredient. Any or none of the inactive ingredients used may have been approved by the US Food and Drug Administration (FDA). A non-exhaustive list of inactive ingredients for use in pharmaceutical compositions for ophthalmic administration includes acetic acid, alcohol, alcohol, dehydrated, alginic acid, amerchol-cab, ammonium hydroxide, anhydrous trisodium citrate, antipyrine, benzalkonium chloride, benzethonium chloride, benzododecinium bromide, boric acid, caffeine, calcium chloride, carbomer 1342, carbomer 934p, carbomer 940, carbomer homopolymer type b (allyl pentaerythritol crosslinked), carboxymethylcellulose sodium, castor oil, cetyl alcohol, chlorobutanol, chlorobutanol, anhydrous, cholesterol, citric acid, citric acid monohydrate, creatinine, diethanolamine, diethylhexyl phthalate, divinylbenzene styrene copolymer, edetate disodium, edetate disodium anhydrous, edetate sodium, ethylene vinyl acetate copolymer, gellan gum (low acyl), glycerin, glyceryl stearate, high density polyethylene, hydrocarbon gel, plasticized, hydrochloric acid, hydrochloric acid, diluted, hydroxyethyl cellulose, hydroxypropyl methylcellulose 2906, hypromellose 2910 (15000 mpa·s), hypromelloses, jelene, lanolin, lanolin alcohols, lanolin anhydrous, lanolin nonionic derivatives, lauralkonium chloride, lauroyl sarcosine, light mineral oil, magnesium chloride, mannitol, methylcellulose (4000 mpa·s), methylcelluloses, methylparaben, mineral oil, nitric acid, nitrogen, nonoxynol-9, octoxynol-40, octylphenol polymethylene, petrolatum, petrolatum, white, phenylethyl alcohol, phenylmercuric acetate, phenylmercuric nitrate, phosphoric acid, polidronium chloride, poloxamer 188, poloxamer 407, polycarbophil, polyethylene glycol 300, polyethylene glycol 400, polyethylene glycol 8000, polyoxyethylene-polyoxypropylene 1800, polyoxyl 35 castor oil, polyoxyl 40 hydrogenated castor oil, polyoxyl 40 stearate, polypropylene glycol, polysorbate 20, polysorbate 60, polysorbate 80, polyvinyl alcohol, potassium acetate, potassium chloride, potassium phosphate, monobasic, potassium sorbate, povidone k29/32, povidone k30, povidone k90, povidones, propylene glycol, propylparaben, soda ash, sodium acetate, sodium bisulfate, sodium bisulfite, sodium borate, sodium borate decahydrate, sodium carbonate, sodium carbonate monohydrate, sodium chloride, sodium citrate, sodium hydroxide, sodium metabisulfite, sodium nitrate, sodium phosphate, sodium phosphate dihydrate, sodium phosphate, dibasic, sodium phosphate, dibasic, anhydrous, sodium phosphate, dibasic, dihydrate, sodium phosphate, dibasic, heptahydrate, sodium phosphate, monobasic, sodium phosphate, monobasic, anhydrous, sodium phosphate, monobasic, dihydrate, sodium phosphate, monobasic, monohydrate, sodium sulfate, sodium sulfate anhydrous, sodium sulfate decahydrate, sodium sulfite, sodium thiosulfate, sorbic acid, sorbitan monolaurate, sorbitol, sorbitol solution, stabilized oxychloro complex, sulfuric acid, thimerosal, titanium dioxide, tocophersolan, trisodium citrate dihydrate, triton 720, tromethamine, tyloxapol and zinc chloride.

A pharmaceutical NAV composition for retrobulbar administration may comprise at least one inactive ingredient. Any or none of the inactive ingredients used may have been approved by the US Food and Drug Administration (FDA). A non-exhaustive list of inactive ingredients for use in pharmaceutical compositions for retrobulbar administration includes hydrochloric acid and sodium hydroxide.

A pharmaceutical NAV composition for intraocular administration may comprise at least one inactive ingredient. Any or none of the inactive ingredients used may have been approved by the US Food and Drug Administration (FDA). A non-exhaustive list of inactive ingredients for use in pharmaceutical compositions for intraocular administration includes benzalkonium chloride, calcium chloride, citric acid monohydrate, hydrochloric acid, magnesium chloride, polyvinyl alcohol, potassium chloride, sodium acetate, sodium chloride, sodium citrate and sodium hydroxide.

A pharmaceutical NAV composition for intravitreal administration may comprise at least one inactive ingredient. Any or none of the inactive ingredients used may have been approved by the US Food and Drug Administration (FDA). A non-exhaustive list of inactive ingredients for use in pharmaceutical compositions for intravitreal administration includes calcium chloride, carboxymethylcellulose sodium, cellulose, microcrystalline, hyaluronate sodium, hydrochloric acid, magnesium chloride, magnesium stearate, polysorbate 80, polyvinyl alcohol, potassium chloride, sodium acetate, sodium bicarbonate, sodium carbonate, sodium chloride, sodium hydroxide, sodium phosphate dibasic heptahydrate, sodium phosphate monobasic monohydrate and trisodium citrate dehydrate.

A pharmaceutical NAV composition for subconjunctival administration may comprise at least one inactive ingredient. Any or none of the inactive ingredients used may have been approved by the US Food and Drug Administration (FDA). A non-exhaustive list of inactive ingredients for use in pharmaceutical compositions for subconjunctival administration includes benzyl alcohol, hydrochloric acid and sodium hydroxide.

A pharmaceutical NAV composition for auricular administration may comprise at least one inactive ingredient. Any or none of the inactive ingredients used may have been approved by the US Food and Drug Administration (FDA). A non-exhaustive list of inactive ingredients for use in pharmaceutical compositions for auricular administration includes acetic acid, aluminum acetate, aluminum sulfate anhydrous, benzalkonium chloride, benzethonium chloride, benzyl alcohol, boric acid, calcium carbonate, cetyl alcohol, chlorobutanol, chloroxylenol, citric acid, creatinine, cupric sulfate, cupric sulfate anhydrous, edetate disodium, edetic acid, glycerin, glyceryl stearate, hydrochloric acid, hydrocortisone, hydroxyethyl cellulose, isopropyl myristate, lactic acid, lecithin, hydrogenated, methylparaben, mineral oil, petrolatum, petrolatum, white, phenylethyl alcohol, polyoxyl 40 stearate, polyoxyl stearate, polysorbate 20, polysorbate 80, polyvinyl alcohol, potassium metabisulfite, potassium phosphate, monobasic, povidone k90f, povidones, propylene glycol, propylene glycol diacetate, propylparaben, sodium acetate, sodium bisulfite, sodium borate, sodium chloride, sodium citrate, sodium hydroxide, sodium phosphate, dibasic, anhydrous, sodium phosphate, dibasic, heptahydrate, sodium phosphate, monobasic, anhydrous, sodium sulfite, sulfuric acid and thimerosal.

Payload Administration: Detectable Agents and Therapeutic Agents

The NAVs described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

NAVs described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In addition, the NAVs described herein can be used to deliver therapeutic agents to cells or tissues, e.g., in living animals. For example, the NAVs described herein can be used to deliver highly polar chemotherapeutics agents to kill cancer cells. The NAVs attached to the therapeutic agent through a linker can facilitate member permeation allowing the therapeutic agent to travel into a cell to reach an intracellular target.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{201}$Tl, $^{125}$I, $^{35}$S, $^{14}$C, $^{3}$H, or $^{99m}$Tc (e.g., as pertechnetate (technetate(VII), TcO$_4^-$ and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn- DPDP), barium sulfate, iodinated contrast media (iohexol), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl] naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine (1:1) (IR144); 5-chloro-2-[2-[3-[(5-chloro-3-ethyl-2(3H)-benzothiazolylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodarnine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.
Combinations The NAVs may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body.

The combinations can conveniently be presented for use in the form of a pharmaceutical formulation and thus pharmaceutical compositions comprising a combination as defined above together with a pharmaceutically acceptable diluent or carrier represent a further aspect of the invention.

The individual compounds of such combinations can be administered either sequentially or simultaneously in separate or combined pharmaceutical formulations. In one embodiment, the individual compounds will be administered simultaneously in a combined pharmaceutical formulation.

It will further be appreciated that therapeutically, prophylactically, diagnostically, or imaging active agents utilized in combination may be administered together in a single composition or administered separately in different compositions. In general, it is expected that agents utilized in combination with be utilized at levels that do not exceed the levels at which they are utilized individually. In some embodiments, the levels utilized in combination will be lower than those utilized individually. In one embodiment, the combinations, each or together may be administered according to the split dosing regimens described herein.
Dosing The present invention provides methods comprising administering NAVs and in accordance with the invention to a subject in need thereof. The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect (see e.g., the range of unit doses described in International Publication No WO2013078199, herein incorporated by reference in its entirety). The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used.

According to the present invention, NAVs may be administered in split-dose regimens. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the NAVs of the present invention are administed to a subject in split doses. The NAVs may be formulated in buffer only or in a formulation described herein.

Dosage Forms

A NAV pharmaceutical composition described herein can be formulated into a dosage form described herein, such as an intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of the NAVs then depends upon its rate of dissolution which, in turn, may depend upon crystal size and crystalline form. Alternatively, delayed absorption of a parenterally administered NAV may be accomplished by dissolving or suspending the NAVs in an oil vehicle. Injectable depot forms are made by forming microencapsule matrices of the NAVs in biodegradable polymers such as polylactide-polyglycolide. Depending upon the ratio of NAVs to polymer and the nature of the particular polymer employed, the rate of polynucleotides release can be controlled. Examples of other biodegradable polymers include, but are not limited to, poly(orthoesters) and poly(anhydrides). Depot injectable formulations may be prepared by entrapping the NAVs in liposomes or microemulsions which are compatible with body tissues.

Pulmonary

Formulations described herein as being useful for pulmonary delivery may also be used for intranasal delivery of a pharmaceutical composition. Another formulation suitable for intranasal administration may be a coarse powder comprising the active ingredient and having an average particle from about 0.2 μm to 500 μm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy 21$^{st}$ ed., Lippincott Williams & Wilkins, 2005 (incorporated herein by reference in its entirety).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Multi-Dose and Repeat-Dose Administration

In some embodiments, NAV compounds and/or compositions of the present invention may be administered in two or more doses (referred to herein as "multi-dose administration"). Such doses may comprise the same components or may comprise components not included in a previous dose. Such doses may comprise the same mass and/or volume of components or an altered mass and/or volume of components in comparison to a previous dose. In some embodiments, multi-dose administration may comprise repeat-dose administration. As used herein, the term "repeat-dose administration" refers to two or more doses administered consecutively or within a regimen of repeat doses comprising substantially the same components provided at substantially the same mass and/or volume. In some embodiments, subjects may display a repeat-dose response. As used herein, the term "repeat-dose response" refers to a response in a subject to a repeat-dose that differs from that of another dose administered within a repeat-dose administration regimen. In some embodiments, such a response may be the expression of a protein in response to a repeat-dose comprising NAV. In such embodiments, protein expression may be elevated in comparison to another dose administered within a repeat-dose administration regimen or protein expression may be reduced in comparison to another dose administered within a repeat-dose administration regimen. Alteration of protein expression may be from about 1% to about 20%, from about 5% to about 50% from about 10% to about 60%, from about 25% to about 75%, from about 40% to about 100% and/or at least 100%. A reduction in expression of mRNA administered as part of a repeat-dose regimen, wherein the level of protein translated from the administered RNA is reduced by more than 40% in comparison to another dose within the repeat-dose regimen is referred to herein as "repeat-dose resistance."

Properties of the Pharmaceutical Compositions

The NAV pharmaceutical compositions described herein can be characterized by one or more of the following properties:

Bioavailability

The NAVs, when formulated into a composition with a delivery agent as described herein, can exhibit an increase in bioavailability as compared to a composition lacking a delivery agent as described herein. As used herein, the term "bioavailability" refers to the systemic availability of a given amount of NAVs administered to a mammal. Bioavailability can be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, herein incorporated by reference in its entirety.

The $C_{max}$ value is the maximum concentration of the compound achieved in the serum or plasma of a mammal following administration of the compound to the mammal. The $C_{max}$ value of a particular compound can be measured using methods known to those of ordinary skill in the art. The phrases "increasing bioavailability" or "improving the pharmacokinetics," as used herein mean that the systemic availability of a first NAV, measured as AUC, $C_{max}$, or $C_{min}$ in a mammal is greater, when co-administered with a delivery agent as described herein, than when such co-administration does not take place. In some embodiments, the bioavailability of the NAVs can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

In some embodiments, liquid formulations of NAVs may have varying in vivo half-life, requiring modulation of doses to yield a therapeutic effect. To address this, in some embodiments of the present invention, NAV formulations may be designed to improve bioavailability and/or therapeutic effect during repeat administrations. Such formulations may enable sustained release of NAVs and/or reduce NAV degradation rates by nucleases. In some embodiments, suspension formulations are provided comprising NAVs, water immiscible oil depots, surfactants and/or co-surfactants and/or co-solvents. Combinations of oils and surfactants may enable suspension formulation with NAVs. Delivery of NAVs in a water immiscible depot may be used to improve bioavailability through sustained release of polynucleotides from the depot to the surrounding physiologic environment and/or prevent polynucleotide degradation by nucleases.

In some embodiments, cationic nanoparticles comprising combinations of divalent and monovalent cations may be formulated with NAVs. Such nanoparticles may form spontaneously in solution over a given period (e.g. hours, days, etc). Such nanoparticles do not form in the presence of divalent cations alone or in the presence of monovalent cations alone. The delivery of NAVs in cationic nanoparticles or in one or more depot comprising cationic nanoparticles may improve NAV bioavailability by acting as a long-acting depot and/or reducing the rate of degradation by nucleases.

Therapeutic Window

The NAVs, when formulated into a composition with a delivery agent as described herein, can exhibit an increase in the therapeutic window of the administered NAV composition as compared to the therapeutic window of the administered NAV composition lacking a delivery agent as described herein. As used herein "therapeutic window" refers to the range of plasma concentrations, or the range of levels of therapeutically active substance at the site of action, with a high probability of eliciting a therapeutic effect. In some embodiments, the therapeutic window of the NAVs when co-administered with a delivery agent as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

The NAVs, when formulated into a composition with a delivery agent as described herein, can exhibit an improved volume of distribution ($V_{dist}$), e.g., reduced or targeted, relative to a composition lacking a delivery agent as described herein. The volume of distribution (Vdist) relates the amount of the drug in the body to the concentration of the drug in the blood or plasma. As used herein, the term "volume of distribution" refers to the fluid volume that would be required to contain the total amount of the drug in the body at the same concentration as in the blood or plasma: Vdist equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, Vdist can be used to determine a loading dose to achieve a steady state concentration. In some embodiments, the volume of distribution of the NAVs when co-administered with a delivery agent as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the NAV delivered to the animals may be categorized by analyzing the protein expression in the animals. The protein expression may be determined from analyzing a biological sample collected from a mammal administered the NAV of the present invention Detection of Polynucleotides by Mass Spectrometry Mass spectrometry (MS) is an analytical technique that can provide structural and molecular mass/concentration information on molecules after their conversion to ions. The molecules are first ionized to acquire positive or negative charges and then they travel through the mass analyzer to arrive at different areas of the detector according to their mass/charge (m/z) ratio.

Mass spectrometry is performed using a mass spectrometer which includes an ion source for ionizing the fractionated sample and creating charged molecules for further analysis. For example ionization of the sample may be performed by electrospray ionization (ESI), atmospheric pressure chemical ionization (APCI), photoionization, electron ionization, fast atom bombardment (FAB)/liquid secondary ionization (LSIMS), matrix assisted laser desorption/ionization (MALDI), field ionization, field desorption, thermospray/plasmaspray ionization, and particle beam ionization. The skilled artisan will understand that the choice of ionization method can be determined based on the analyte to be measured, type of sample, the type of detector, the choice of positive versus negative mode, etc.

After the sample has been ionized, the positively charged or negatively charged ions thereby created may be analyzed to determine a mass-to-charge ratio (i.e., m/z). Suitable analyzers for determining mass-to-charge ratios include quadropole analyzers, ion traps analyzers, and time-of-flight analyzers. The ions may be detected using several detection modes. For example, selected ions may be detected (i.e., using a selective ion monitoring mode (SIM)), or alternatively, ions may be detected using a scanning mode, e.g., multiple reaction monitoring (MRM) or selected reaction monitoring (SRM).

Liquid chromatography-multiple reaction monitoring (LC-MS/MRM) coupled with stable isotope labeled dilution of peptide standards has been shown to be an effective method for protein verification (e.g., Keshishian et al., Mol Cell Proteomics 2009 8: 2339-2349; Kuhn et al., Clin Chem 2009 55:1108-1117; Lopez et al., Clin Chem 2010 56:281-290; each of which are herein incorporated by reference in its entirety). Unlike untargeted mass spectrometry frequently used in biomarker discovery studies, targeted MS methods are peptide sequence-based modes of MS that focus the full analytical capacity of the instrument on tens to hundreds of selected peptides in a complex mixture. By restricting detection and fragmentation to only those peptides derived from proteins of interest, sensitivity and reproducibility are improved dramatically compared to discovery-mode MS methods. This method of mass spectrometry-based multiple reaction monitoring (MRM) quantitation of proteins can dramatically impact the discovery and quantitation of biomarkers via rapid, targeted, multiplexed protein expression profiling of clinical samples.

In one embodiment, a biological sample which may contain at least one protein encoded by at least one modified mRNA of the present invention may be analyzed by the method of MRM-MS. The quantification of the biological sample may further include, but is not limited to, isotopically labeled peptides or proteins as internal standards.

According to the present invention, the biological sample, once obtained from the subject, may be subjected to enzyme digestion. As used herein, the term "digest" means to break apart into shorter peptides. As used herein, the phrase "treating a sample to digest proteins" means manipulating a sample in such a way as to break down proteins in a sample. These enzymes include, but are not limited to, trypsin, endoproteinase Glu-C and chymotrypsin. In one embodiment, a biological sample which may contain at least one protein encoded by at least one modified mRNA of the present invention may be digested using enzymes.

In one embodiment, a biological sample which may contain protein encoded by modified mRNA of the present invention may be analyzed for protein using electrospray ionization. Electrospray ionization (ESI) mass spectrometry (ESIMS) uses electrical energy to aid in the transfer of ions from the solution to the gaseous phase before they are analyzed by mass spectrometry. Samples may be analyzed using methods known in the art (e.g., Ho et al., Clin Biochem Rev. 2003 24(1):3-12; herein incorporated by reference in its entirety). The ionic species contained in solution may be transferred into the gas phase by dispersing a fine spray of charge droplets, evaporating the solvent and ejecting the ions from the charged droplets to generate a mist of highly charged droplets. The mist of highly charged droplets may be analyzed using at least 1, at least 2, at least 3 or at least 4 mass analyzers such as, but not limited to, a quadropole mass analyzer. Further, the mass spectrometry method may include a purification step. As a non-limiting example, the first quadrapole may be set to select a single m/z ratio so it may filter out other molecular ions having a different m/z ratio which may eliminate complicated and time-consuming sample purification procedures prior to MS analysis.

In one embodiment, a biological sample which may contain protein encoded by modified mRNA of the present invention may be analyzed for protein in a tandem ESIMS system (e.g., MS/MS). As non-limiting examples, the droplets may be analyzed using a product scan (or daughter scan) a precursor scan (parent scan) a neutral loss or a multiple reaction monitoring.

In one embodiment, a biological sample which may contain protein encoded by modified mRNA of the present invention may be analyzed using matrix-assisted laser desorption/ionization (MALDI) mass spectrometry (MALDIMS). MALDI provides for the nondestructive vaporization and ionization of both large and small molecules, such as proteins. In MALDI analysis, the analyte is first co-crystallized with a large molar excess of a matrix compound, which may also include, but is not limited to, an ultraviolet absorbing weak organic acid. Non-limiting examples of matrices used in MALDI are α-cyano-4-hydroxycinnamic acid, 3,5-dimethoxy-4-hydroxycinnamic acid and 2,5-dihydroxybenzoic acid. Laser radiation of the analyte-matrix mixture may result in the vaporization of the matrix and the analyte. The laser induced desorption provides high ion yields of the intact analyte and allows for measurement of compounds with high accuracy. Samples may be analyzed using methods known in the art (e.g., Lewis, Wei and Siuzdak, Encyclopedia of Analytical Chemistry 2000:5880-5894; herein incorporated by reference in its entirety). As non-limiting examples, mass analyzers used in the MALDI analysis may include a linear time-of-flight (TOF), a TOF reflectron or a Fourier transform mass analyzer.

In one embodiment, the analyte-matrix mixture may be formed using the dried-droplet method. A biologic sample is mixed with a matrix to create a saturated matrix solution where the matrix-to-sample ratio is approximately 5000:1. An aliquot (approximately 0.5-2.0 uL) of the saturated matrix solution is then allowed to dry to form the analyte-matrix mixture.

In one embodiment, the analyte-matrix mixture may be formed using the thin-layer method. A matrix homogeneous film is first formed and then the sample is then applied and may be absorbed by the matrix to form the analyte-matrix mixture.

In one embodiment, the analyte-matrix mixture may be formed using the thick-layer method. A matrix homogeneous film is formed with a nitro-cellulose matrix additive. Once the uniform nitro-cellulose matrix layer is obtained the sample is applied and absorbed into the matrix to form the analyte-matrix mixture.

In one embodiment, the analyte-matrix mixture may be formed using the sandwich method. A thin layer of matrix crystals is prepared as in the thin-layer method followed by the addition of droplets of aqueous trifluoroacetic acid, the sample and matrix. The sample is then absorbed into the matrix to form the analyte-matrix mixture.

VI. Kits and Devices

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the NAV molecules (including any proteins or polynucleotides) of the invention. In one embodiment, the kit comprises one or more functional antigens or function fragments thereof.

The kits can be for protein production, comprising a first polynucleotides comprising a translatable region of an antigen. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See e.g., U.S. Pub. No. 20120258046; herein incorporated by reference in its entirety). In a futher embodiment, the buffer solutions may be precipitated or it may be lyophilized. The amount of each component may be varied to enable consistent, reproducible higher concentration saline or simple buffer formulations.

The components may also be varied in order to increase the stability of polynucleotides in the buffer solution over a period of time and/or under a variety of conditions.

In one aspect, the present invention provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present invention provides kits for protein production, comprising a polynucleotide comprising a translatable region, wherein the polynucleotide exhibits reduced degradation by a cellular nuclease, and packaging and instructions.

In one aspect, the present invention provides kits for protein production, comprising a polynucleotide comprising a translatable region, wherein the polynucleotide exhibits reduced degradation by a cellular nuclease, and a mammalian cell suitable for translation of the translatable region of the first nucleic acid.

Devices

The present invention provides for devices which may incorporate RNAVs comprising polynucleotides that encode polypeptides of interest, e.g., encode antigenic polypeptides. These devices contain in a stable formulation the reagents to synthesize a polynucleotide in a formulation available to be immediately delivered to a subject in need thereof, such as a human patient.

Devices for administration may be employed to deliver the NAVs of the present invention according to single, multi- or split-dosing regimens taught herein. Such devices are taught in, for example, International Application PCT/US2013/30062 filed Mar. 9, 2013, the contents of which are incorporated herein by reference in their entirety.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices may be utilized to deliver the single, multi- or split doses contemplated herein. Such devices are taught for example in, International Application PCT/US2013/30062 filed Mar. 9, 2013, the contents of which are incorporated herein by reference in their entirety.

In one embodiment, the NAV is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period).

Methods and Devices Utilizing Catheters and/or Lumens

Methods and devices using catheters and lumens may be employed to administer the NAVs of the present invention on a single, multi- or split dosing schedule. Such methods and devices are described in International Application PCT/US2013/30062 filed Mar. 9, 2013, the contents of which are incorporated herein by reference in their entirety.

Methods and Devices Utilizing Electrical Current

Methods and devices utilizing electric current may be employed to deliver the NAVs of the present invention according to the single, multi- or split dosing regimens taught herein. Such methods and devices are described in International Application PCT/US2013/30062 filed Mar. 9, 2013, the contents of which are incorporated herein by reference in their entirety.

VII. Definitions

At various places in the present specification, substituents of compounds of the present disclosure are disclosed in groups or in ranges. It is specifically intended that the present disclosure include each and every individual subcombination of the members of such groups and ranges. For example, the term "$C_{1-6}$ alkyl" is specifically intended to individually disclose methyl, ethyl, $C_3$ alkyl, $C_4$ alkyl, $C_5$ alkyl, and $C_6$ alkyl. Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

About: As used herein, the term "about" means+/−10% of the recited value.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Adjuvant: As used herein, the term "adjuvant" means a substance that enhances a subject's immune response to an antigen. The NAVs of the present invention may optionally comprise one or more adjuvants.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigen: As defined herein, the term "antigen" or "antibody generator" ("Ag") refers to a composition, for example, a substance or agent which causes an immune response in an organism, e.g., causes the immune response of the organism to produce antibodies against the substance or agent in particular, which provokes an adaptive immune response in an organism. Antigens can be any immunogenic substance including, in particular, proteins, polypeptides, polysaccharides, nucleic acids, lipids and the like. Exemplary antigens are derived from infectious agents. Such agents can include parts or subunits of infectious agents, for example, coats, coat components, e.g., coat protein or polypeptides, surface components, e.g., surface proteins or polypeptides, capsule components, cell wall components, flagella, fimbrae, and/or toxins or toxoids) of infectious agents, for example, bacteria, viruses, and other microorganisms. Certain antigens, for example, lipids and/or nucleic acids are antigenic, preferably, when combined with proteins and/or polysaccharides.

Antigens of interest or desired antigens: As used herein, the terms "antigens of interest" or "desired antigens" include those proteins and other biomolecules provided herein that are components of or encoded by polynucleotides which are components of one or more NAVs.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present invention may be considered biologically active if even a portion of the polynucleotides is biologically active or mimics an activity considered biologically relevant.

Cancer stem cells: As used herein, "cancer stem cells" are cells that can undergo self-renewal and/or abnormal proliferation and differentiation to form a tumor.

Chemical terms: The following provides the definition of various chemical terms from "acyl" to "thiol."

The term "acyl," as used herein, represents a hydrogen or an alkyl group (e.g., a haloalkyl group), as defined herein, that is attached to the parent molecular group through a carbonyl group, as defined herein, and is exemplified by formyl (i.e., a carboxyaldehyde group), acetyl, trifluoroacetyl, propionyl, butanoyl and the like. Exemplary unsubstituted acyl groups include from 1 to 7, from 1 to 11, or from 1 to 21 carbons. In some embodiments, the alkyl group is further substituted with 1, 2, 3, or 4 substituents as described herein.

Non-limiting examples of optionally substituted acyl groups include, alkoxycarbonyl, alkoxycarbonylacyl, arylalkoxycarbonyl, aryloyl, carbamoyl, carboxyaldehyde, (heterocyclyl) imino, and (heterocyclyl)oyl:

The "alkoxycarbonyl" group, which as used herein, represents an alkoxy, as defined herein, attached to the parent molecular group through a carbonyl atom (e.g., —C(O)—OR, where R is H or an optionally substituted $C_{1-6}$, $C_{1-10}$, or $C_{1-20}$ alkyl group). Exemplary unsubstituted alkoxycarbonyl include from 1 to 21 carbons (e.g., from 1 to 11 or from 1 to 7 carbons). In some embodiments, the alkoxy group is further substituted with 1, 2, 3, or 4 substituents as described herein.

The "alkoxycarbonylacyl" group, which as used herein, represents an acyl group, as defined herein, that is substituted with an alkoxycarbonyl group, as defined herein (e.g., —C(O)-alkyl-C(O)—OR, where R is an optionally substituted $C_{1-6}$, $C_{1-10}$, or $C_{1-20}$ alkyl group). Exemplary unsubstituted alkoxycarbonylacyl include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ acyl, $C_{1-10}$ alkoxycarbonyl-$C_{1-10}$ acyl, or $C_{1-20}$ alkoxycarbonyl-$C_{1-20}$ acyl). In some embodiments, each alkoxy and alkyl group is further independently substituted with 1, 2, 3, or 4 substituents, as described herein (e.g., a hydroxy group) for each group.

The "arylalkoxycarbonyl" group, which as used herein, represents an arylalkoxy group, as defined herein, attached to the parent molecular group through a carbonyl (e.g., —C(O)—O-alkyl-aryl). Exemplary unsubstituted arylalkoxy groups include from 8 to 31 carbons (e.g., from 8 to 17 or from 8 to 21 carbons, such as $C_{6-10}$ aryl-$C_{1-6}$ alkoxy-carbonyl, $C_{6-10}$ aryl-$C_{1-10}$ alkoxy-carbonyl, or $C_{6-10}$ aryl-$C_{1-20}$ alkoxy-carbonyl). In some embodiments, the arylalkoxycarbonyl group can be substituted with 1, 2, 3, or 4 substituents as defined herein.

The "aryloyl" group, which as used herein, represents an aryl group, as defined herein, that is attached to the parent molecular group through a carbonyl group. Exemplary unsubstituted aryloyl groups are of 7 to 11 carbons. In some embodiments, the aryl group can be substituted with 1, 2, 3, or 4 substituents as defined herein.

The "carbamoyl" group, which as used herein, represents —C(O)—N($R^{N1}$)$_2$, where the meaning of each $R^{N1}$ is found in the definition of "amino" provided herein.

The "carboxyaldehyde" group, which as used herein, represents an acyl group having the structure —CHO.

The "(heterocyclyl) imino" group, which as used herein, represents a heterocyclyl group, as defined herein, attached to the parent molecular group through an imino group. In some embodiments, the heterocyclyl group can be substituted with 1, 2, 3, or 4 substituent groups as defined herein.

The "(heterocyclyl)oyl" group, which as used herein, represents a heterocyclyl group, as defined herein, attached to the parent molecular group through a carbonyl group. In some embodiments, the heterocyclyl group can be substituted with 1, 2, 3, or 4 substituent groups as defined herein.

The term "alkyl," as used herein, is inclusive of both straight chain and branched chain saturated groups from 1 to 20 carbons (e.g., from 1 to 10 or from 1 to 6), unless otherwise specified. Alkyl groups are exemplified by methyl, ethyl, n- and iso-propyl, n-, sec-, iso- and tert-butyl, neopentyl, and the like, and may be optionally substituted with one, two, three, or, in the case of alkyl groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —NH$_2$) or a substituted amino (i.e., —N($R^{N1}$)$_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy, optionally substituted with an O-protecting group; (9) nitro; (10) oxo (e.g., carboxyaldehyde or acyl); (11) $C_{1-7}$ spirocyclyl; (12) thioalkoxy; (13) thiol; (14) —CO$_2R^{A'}$, optionally substituted with an O-protecting group and where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$ (CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) —C(O)NR$^{B'}$R$^{C'}$, where each of $R^{B'}$ and $R^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) —SO$_2R^{D'}$, where $R^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) —SO$_2$NR$^{E'}$R$^{F'}$, where each of $R^{E'}$ and $R^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) —C(O)R$^{G'}$, where $R^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of —(CH$_2$)$_{s2}$(OCH$_2$CH$_2$)$_{s1}$ (CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or C$_{1-20}$ alkyl, and (h) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted C$_{1-6}$ alkyl; (19) —NR$^{H'}$C(O)R$^{I'}$, wherein R$^{H'}$ is selected from the group consisting of (a1) hydrogen and (b1) C$_{1-6}$ alkyl, and R$^{I'}$ is selected from the group consisting of (a2) C$_{1-20}$ alkyl (e.g., C$_{1-6}$ alkyl), (b2) C$_{2-20}$ alkenyl (e.g., C$_{2-6}$ alkenyl), (c2) C$_{6-10}$ aryl, (d2) hydrogen, (e2) C$_{1-6}$ alk-C$_{6-10}$ aryl, (f2) amino-C$_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or C$_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted C$_{1-6}$ alkyl; (20) —NR$^{J'}$C(O)OR$^{K'}$, wherein R$^{J'}$ is selected from the group consisting of (a1) hydrogen and (b1) C$_{1-6}$ alkyl, and R$^{K'}$ is selected from the group consisting of (a2) C$_{1-20}$ alkyl (e.g., C$_{1-6}$ alkyl), (b2) C$_{2-20}$ alkenyl (e.g., C$_{2-6}$ alkenyl), (c2) C$_{6-10}$ aryl, (d2) hydrogen, (e2) C$_{1-6}$ alk-C$_{6-10}$ aryl, (f2) amino-C$_{1-20}$ alkyl, (g2) polyethylene glycol of —(CH$_2$)$_{s2}$(OCH$_2$CH$_2$)$_{s1}$(CH$_2$)$_{s3}$OR', wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or C$_{1-20}$ alkyl, and (h2) amino-polyethylene glycol of —NR$^{N1}$(CH$_2$)$_{s2}$(CH$_2$CH$_2$O)$_{s1}$(CH$_2$)$_{s3}$NR$^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each R$^{N1}$ is, independently, hydrogen or optionally substituted C$_{1-6}$ alkyl; and (21) amidine. In some embodiments, each of these groups can be further substituted as described herein. For example, the alkylene group of a C$_1$-alkaryl can be further substituted with an oxo group to afford the respective aryloyl substituent.

The term "alkylene," as used herein, represent a saturated divalent hydrocarbon group derived from a straight or branched chain saturated hydrocarbon by the removal of two hydrogen atoms, and is exemplified by methylene, ethylene, isopropylene, and the like. The term "C$_{x-y}$ alkylene" and the prefix "C$_{x-y}$ alk-" represent alkylene groups having between x and y carbons. Exemplary values for x are 1, 2, 3, 4, 5, and 6, and exemplary values for y are 2, 3, 4, 5, 6, 7, 8, 9, 10, 12, 14, 16, 18, or 20 (e.g., C$_{1-6}$, C$_{1-10}$, C$_{2-20}$, C$_{2-6}$, C$_{2-10}$, or C$_{2-20}$ alkylene). In some embodiments, the alkylene can be further substituted with 1, 2, 3, or 4 substituent groups as defined herein for an alkyl group. Similarly, the suffix "-ene" appended to any group indicates that the group is a divalent group.

Non-limiting examples of optionally substituted alkyl and alkylene groups include acylaminoalkyl, acyloxyalkyl, alkoxyalkyl, alkoxycarbonylalkyl, alkylsulfinyl, alkylsulfi-nylalkyl, aminoalkyl, carbamoylalkyl, carboxyalkyl, carboxyaminoalkyl, haloalkyl, hydroxyalkyl, perfluoroalkyl, and sulfoalkyl:

The "acylaminoalkyl" group, which as used herein, represents an acyl group, as defined herein, attached to an amino group that is in turn attached to the parent molecular group through an alkylene group, as defined herein (i.e., -alkyl-N(R$^{N1}$)—C(O)—R, where R is H or an optionally substituted C$_{1-6}$, C$_{1-10}$, or C$_{1-20}$ alkyl group (e.g., haloalkyl) and R$^{N1}$ is as defined herein). Exemplary unsubstituted acylaminoalkyl groups include from 1 to 41 carbons (e.g., from 1 to 7, from 1 to 13, from 1 to 21, from 2 to 7, from 2 to 13, from 2 to 21, or from 2 to 41 carbons). In some embodiments, the alkylene group is further substituted with 1, 2, 3, or 4 substituents as described herein, and/or the amino group is —NH$_2$ or —NHR$^{N1}$, wherein R$^{N1}$ is, independently, OH, NO$_2$, NH$_2$, NR$^{N2}_2$, SO$_2$OR$^{N2}$, SO$_2$R$^{N2}$, SOR$^{N2}$, alkyl, aryl, acyl (e.g., acetyl, trifluoroacetyl, or others described herein), or alkoxycarbonylalkyl, and each R$^{N2}$ can be H, alkyl, or aryl.

The "acyloxyalkyl" group, which as used herein, represents an acyl group, as defined herein, attached to an oxygen atom that in turn is attached to the parent molecular group though an alkylene group (i.e., -alkyl-O—C(O)—R, where R is H or an optionally substituted C$_{1-6}$, C$_{1-10}$, or C$_{1-20}$ alkyl group). Exemplary unsubstituted acyloxyalkyl groups include from 1 to 21 carbons (e.g., from 1 to 7 or from 1 to 11 carbons). In some embodiments, the alkylene group is, independently, further substituted with 1, 2, 3, or 4 substituents as described herein.

The "alkoxyalkyl" group, which as used herein, represents an alkyl group that is substituted with an alkoxy group. Exemplary unsubstituted alkoxyalkyl groups include between 2 to 40 carbons (e.g., from 2 to 12 or from 2 to 20 carbons, such as C$_{1-6}$ alkoxy-C$_{1-6}$ alkyl, C$_{1-10}$ alkoxy-C$_{1-10}$ alkyl, or C$_{1-20}$ alkoxy-C$_{1-20}$ alkyl). In some embodiments, the alkyl and the alkoxy each can be further substituted with 1, 2, 3, or 4 substituent groups as defined herein for the respective group.

The "alkoxycarbonylalkyl" group, which as used herein, represents an alkyl group, as defined herein, that is substituted with an alkoxycarbonyl group, as defined herein (e.g., -alkyl-C(O)—OR, where R is an optionally substituted C$_{1-20}$, C$_{1-10}$, or C$_{1-6}$ alkyl group). Exemplary unsubstituted alkoxycarbonylalkyl include from 3 to 41 carbons (e.g., from 3 to 10, from 3 to 13, from 3 to 17, from 3 to 21, or from 3 to 31 carbons, such as C$_{1-6}$ alkoxycarbonyl-C$_{1-6}$ alkyl, C$_{1-10}$ alkoxycarbonyl-C$_{1-10}$ alkyl, or C$_{1-20}$ alkoxycarbonyl-C$_{1-20}$ alkyl). In some embodiments, each alkyl and alkoxy group is further independently substituted with 1, 2, 3, or 4 substituents as described herein (e.g., a hydroxy group).

The "alkylsulfinylalkyl" group, which as used herein, represents an alkyl group, as defined herein, substituted with an alkylsulfinyl group. Exemplary unsubstituted alkylsulfinylalkyl groups are from 2 to 12, from 2 to 20, or from 2 to 40 carbons. In some embodiments, each alkyl group can be further substituted with 1, 2, 3, or 4 substituent groups as defined herein.

The "aminoalkyl" group, which as used herein, represents an alkyl group, as defined herein, substituted with an amino group, as defined herein. The alkyl and amino each can be further substituted with 1, 2, 3, or 4 substituent groups as described herein for the respective group (e.g., CO$_2$R$^{A'}$, where R$^{A'}$ is selected from the group consisting of (a) C$_{1-6}$ alkyl, (b) C$_{6-10}$ aryl, (c) hydrogen, and (d) C$_{1-6}$ alk-C$_{6-10}$ aryl, e.g., carboxy, and/or an N-protecting group).

The "carbamoylalkyl" group, which as used herein, represents an alkyl group, as defined herein, substituted with a carbamoyl group, as defined herein. The alkyl group can be further substituted with 1, 2, 3, or 4 substituent groups as described herein.

The "carboxyalkyl" group, which as used herein, represents an alkyl group, as defined herein, substituted with a carboxy group, as defined herein. The alkyl group can be further substituted with 1, 2, 3, or 4 substituent groups as described herein, and the carboxy group can be optionally substituted with one or more 0-protecting groups.

The "carboxyaminoalkyl" group, which as used herein, represents an aminoalkyl group, as defined herein, substituted with a carboxy, as defined herein. The carboxy, alkyl, and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy, and/or an N-protecting group, and/or an O-protecting group).

The "haloalkyl" group, which as used herein, represents an alkyl group, as defined herein, substituted with a halogen group (i.e., F, Cl, Br, or I). A haloalkyl may be substituted with one, two, three, or, in the case of alkyl groups of two carbons or more, four halogens. Haloalkyl groups include perfluoroalkyls (e.g., —$CF_3$), —$CHF_2$, —$CH_2F$, —$CCl_3$, —$CH_2CH_2Br$, —$CH_2CH(CH_2CH_2Br)CH_3$, and —$CHICH_3$. In some embodiments, the haloalkyl group can be further substituted with 1, 2, 3, or 4 substituent groups as described herein for alkyl groups.

The "hydroxyalkyl" group, which as used herein, represents an alkyl group, as defined herein, substituted with one to three hydroxy groups, with the proviso that no more than one hydroxy group may be attached to a single carbon atom of the alkyl group, and is exemplified by hydroxymethyl, dihydroxypropyl, and the like. In some embodiments, the hydroxyalkyl group can be substituted with 1, 2, 3, or 4 substituent groups (e.g., O-protecting groups) as defined herein for an alkyl.

The "perfluoroalkyl" group, which as used herein, represents an alkyl group, as defined herein, where each hydrogen radical bound to the alkyl group has been replaced by a fluoride radical. Perfluoroalkyl groups are exemplified by trifluoromethyl, pentafluoroethyl, and the like.

The "sulfoalkyl" group, which as used herein, represents an alkyl group, as defined herein, substituted with a sulfo group of —$SO_3H$. In some embodiments, the alkyl group can be further substituted with 1, 2, 3, or 4 substituent groups as described herein, and the sulfo group can be further substituted with one or more O-protecting groups (e.g., as described herein).

The term "alkenyl," as used herein, represents monovalent straight or branched chain groups of, unless otherwise specified, from 2 to 20 carbons (e.g., from 2 to 6 or from 2 to 10 carbons) containing one or more carbon-carbon double bonds and is exemplified by ethenyl, 1-propenyl, 2-propenyl, 2-methyl-1-propenyl, 1-butenyl, 2-butenyl, and the like. Alkenyls include both cis and trans isomers. Alkenyl groups may be optionally substituted with 1, 2, 3, or 4 substituent groups that are selected, independently, from amino, aryl, cycloalkyl, or heterocyclyl (e.g., heteroaryl), as defined herein, or any of the exemplary alkyl substituent groups described herein.

Non-limiting examples of optionally substituted alkenyl groups include, alkoxycarbonylalkenyl, aminoalkenyl, and hydroxyalkenyl:

The "alkoxycarbonylalkenyl" group, which as used herein, represents an alkenyl group, as defined herein, that is substituted with an alkoxycarbonyl group, as defined herein (e.g., -alkenyl-C(O)—OR, where R is an optionally substituted $C_{1-20}$, $C_{1-10}$, or $C_{1-6}$ alkyl group). Exemplary unsubstituted alkoxycarbonylalkenyl include from 4 to 41 carbons (e.g., from 4 to 10, from 4 to 13, from 4 to 17, from 4 to 21, or from 4 to 31 carbons, such as $C_{1-6}$ alkoxycarbonyl-$C_{2-6}$ alkenyl, $C_{1-10}$ alkoxycarbonyl-$C_{2-10}$ alkenyl, or $C_{1-20}$ alkoxycarbonyl-$C_{2-20}$ alkenyl). In some embodiments, each alkyl, alkenyl, and alkoxy group is further independently substituted with 1, 2, 3, or 4 substituents as described herein (e.g., a hydroxy group).

The "aminoalkenyl" group, which as used herein, represents an alkenyl group, as defined herein, substituted with an amino group, as defined herein. The alkenyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy, and/or an N-protecting group).

The "hydroxyalkenyl" group, which as used herein, represents an alkenyl group, as defined herein, substituted with one to three hydroxy groups, with the proviso that no more than one hydroxy group may be attached to a single carbon atom of the alkyl group, and is exemplified by dihydroxypropenyl, hydroxyisopentenyl, and the like. In some embodiments, the hydroxyalkenyl group can be substituted with 1, 2, 3, or 4 substituent groups (e.g., O-protecting groups) as defined herein for an alkyl.

The term "alkynyl," as used herein, represents monovalent straight or branched chain groups from 2 to 20 carbon atoms (e.g., from 2 to 4, from 2 to 6, or from 2 to 10 carbons) containing a carbon-carbon triple bond and is exemplified by ethynyl, 1-propynyl, and the like. Alkynyl groups may be optionally substituted with 1, 2, 3, or 4 substituent groups that are selected, independently, from aryl, cycloalkyl, or heterocyclyl (e.g., heteroaryl), as defined herein, or any of the exemplary alkyl substituent groups described herein.

Non-limiting examples of optionally substituted alkynyl groups include alkoxycarbonylalkynyl, aminoalkynyl, and hydroxyalkynyl:

The "alkoxycarbonylalkynyl" group, which as used herein, represents an alkynyl group, as defined herein, that is substituted with an alkoxycarbonyl group, as defined herein (e.g., -alkynyl-C(O)—OR, where R is an optionally substituted $C_{1-20}$, $C_{1-10}$, or $C_{1-6}$ alkyl group). Exemplary unsubstituted alkoxycarbonylalkynyl include from 4 to 41 carbons (e.g., from 4 to 10, from 4 to 13, from 4 to 17, from 4 to 21, or from 4 to 31 carbons, such as $C_{1-6}$ alkoxycarbonyl-$C_{2-6}$ alkynyl, $C_{1-10}$ alkoxycarbonyl-$C_{2-10}$ alkynyl, or $C_{1-20}$ alkoxycarbonyl-$C_{2-20}$ alkynyl). In some embodiments, each alkyl, alkynyl, and alkoxy group is further independently substituted with 1, 2, 3, or 4 substituents as described herein (e.g., a hydroxy group).

The "aminoalkynyl" group, which as used herein, represents an alkynyl group, as defined herein, substituted with an amino group, as defined herein. The alkynyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy, and/or an N-protecting group).

The "hydroxyalkynyl" group, which as used herein, represents an alkynyl group, as defined herein, substituted with one to three hydroxy groups, with the proviso that no more than one hydroxy group may be attached to a single carbon atom of the alkyl group. In some embodiments, the hydroxyalkynyl group can be substituted with 1, 2, 3, or 4 substituent groups (e.g., O-protecting groups) as defined herein for an alkyl.

The term "amino," as used herein, represents $-N(R^{N1})_2$, wherein each $R^{N1}$ is, independently, H, OH, $NO_2$, $N(R^{N2})_2$, $SO_2OR^{N2}$, $SO_2R^{N2}$, $SOR^{N2}$, an N-protecting group, alkyl, alkenyl, alkynyl, alkoxy, aryl, alkaryl, cycloalkyl, alkcycloalkyl, carboxyalkyl (e.g., optionally substituted with an O-protecting group, such as optionally substituted arylalkoxycarbonyl groups or any described herein), sulfoalkyl, acyl (e.g., acetyl, trifluoroacetyl, or others described herein), alkoxycarbonylalkyl (e.g., optionally substituted with an O-protecting group, such as optionally substituted arylalkoxycarbonyl groups or any described herein), heterocyclyl (e.g., heteroaryl), or alkheterocyclyl (e.g., alkheteroaryl), wherein each of these recited $R^{N1}$ groups can be optionally substituted, as defined herein for each group; or two $R^{N1}$ combine to form a heterocyclyl or an N-protecting group, and wherein each $R^{N2}$ is, independently, H, alkyl, or aryl. The amino groups of the invention can be an unsubstituted amino (i.e., $-NH_2$) or a substituted amino (i.e., $-N(R^{N1})_2$). In a preferred embodiment, amino is $-NH_2$ or $-NHR^{N1}$, wherein $R^{N1}$ is, independently, OH, $NO_2$, $NH_2$, $NR^{N2}{}_2$, $SO_2OR^{N2}$, $SO_2R^{N2}$, $SOR^{N2}$, alkyl, carboxyalkyl, sulfoalkyl, acyl (e.g., acetyl, trifluoroacetyl, or others described herein), alkoxycarbonylalkyl (e.g., t-butoxycarbonylalkyl) or aryl, and each $R^{N2}$ can be H, $C_{1-20}$ alkyl (e.g., $C_{1-6}$ alkyl), or $C_{6-10}$ aryl.

Non-limiting examples of optionally substituted amino groups include acylamino and carbamyl:

The "acylamino" group, which as used herein, represents an acyl group, as defined herein, attached to the parent molecular group though an amino group, as defined herein (i.e., $-N(R^{N1})-C(O)-R$, where R is H or an optionally substituted $C_{1-6}$, $C_{1-10}$, or $C_{1-20}$ alkyl group (e.g., haloalkyl) and $R^{N1}$ is as defined herein). Exemplary unsubstituted acylamino groups include from 1 to 41 carbons (e.g., from 1 to 7, from 1 to 13, from 1 to 21, from 2 to 7, from 2 to 13, from 2 to 21, or from 2 to 41 carbons). In some embodiments, the alkyl group is further substituted with 1, 2, 3, or 4 substituents as described herein, and/or the amino group is $-NH_2$ or $-NHR^{N1}$, wherein $R^{N1}$ is, independently, OH, $NO_2$, $NH_2$, $NR^{N2}{}_2$, $SO_2OR^{N2}$, $SO_2R^{N2}$, $SOR^{N2}$, alkyl, aryl, acyl (e.g., acetyl, trifluoroacetyl, or others described herein), or alkoxycarbonylalkyl, and each $R^{N2}$ can be H, alkyl, or aryl.

The "carbamyl" group, which as used herein, refers to a carbamate group having the structure $-NR^{N1}C(=O)OR$ or $-OC(=O)N(R^{N1})_2$, where the meaning of each $R^{N1}$ is found in the definition of "amino" provided herein, and R is alkyl, cycloalkyl, alkcycloalkyl, aryl, alkaryl, heterocyclyl (e.g., heteroaryl), or alkheterocyclyl (e.g., alkheteroaryl), as defined herein.

The term "amino acid," as described herein, refers to a molecule having a side chain, an amino group, and an acid group (e.g., a carboxy group of $-CO_2H$ or a sulfo group of $-SO_3H$), wherein the amino acid is attached to the parent molecular group by the side chain, amino group, or acid group (e.g., the side chain). In some embodiments, the amino acid is attached to the parent molecular group by a carbonyl group, where the side chain or amino group is attached to the carbonyl group. Exemplary side chains include an optionally substituted alkyl, aryl, heterocyclyl, alkaryl, alkheterocyclyl, aminoalkyl, carbamoylalkyl, and carboxyalkyl. Exemplary amino acids include alanine, arginine, asparagine, aspartic acid, cysteine, glutamic acid, glutamine, glycine, histidine, hydroxynorvaline, isoleucine, leucine, lysine, methionine, norvaline, ornithine, phenylalanine, proline, pyrrolysine, selenocysteine, serine, taurine, threonine, tryptophan, tyrosine, and valine. Amino acid groups may be optionally substituted with one, two, three, or, in the case of amino acid groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., $-NH_2$) or a substituted amino (i.e., $-N(R^{N1})_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) $-CO_2R^{A'}$, where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of $-NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) $-C(O)NR^{B'}R^{C'}$, where each of $R^{B'}$ and $R^{C'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (16) $-SO_2R^{D'}$, where $R^{D'}$ is selected from the group consisting of (a) $C_{1-6}$ alkyl, (b) $C_{6-10}$ aryl, (c) $C_{1-6}$ alk-$C_{6-10}$ aryl, and (d) hydroxy; (17) $-SO_2NR^{E'}R^{F'}$, where each of $R^{E'}$ and $R^{F'}$ is, independently, selected from the group consisting of (a) hydrogen, (b) $C_{1-6}$ alkyl, (c) $C_{6-10}$ aryl and (d) $C_{1-6}$ alk-$C_{6-10}$ aryl; (18) $-C(O)R^{G'}$, where $R^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alk-$C_{6-10}$ aryl, (f) amino-$C_{1-20}$ alkyl, (g) polyethylene glycol of $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of $-NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (19) $-NR^{H'}C(O)R^{I'}$, wherein $R^{H'}$ is selected from the group consisting of (a1) hydrogen and (b1) $C_{1-6}$ alkyl, and $R^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of $-(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of $-NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{J'}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alk-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein.

The term "aryl," as used herein, represents a mono-, bicyclic, or multicyclic carbocyclic ring system having one or two aromatic rings and is exemplified by phenyl, naphthyl, 1,2-dihydronaphthyl, 1,2,3,4-tetrahydronaphthyl, anthracenyl, phenanthrenyl, fluorenyl, indanyl, indenyl, and the like, and may be optionally substituted with 1, 2, 3, 4, or 5 substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —$(CH_2)_qCO_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —$(CH_2)_qCONR^{B'}R^{C'}$, where q is an integer from zero to four and where $R^{B'}$ and $R^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —$(CH_2)_qSO_2R^{D'}$, where q is an integer from zero to four and where $R^{D'}$ is selected from the group consisting of (a) alkyl, (b) $C_{6-10}$ aryl, and (c) alk-$C_{6-10}$ aryl; (20) —$(CH_2)_qSO_2NR^{E'}R^{F'}$, where q is an integer from zero to four and where each of $R^{E'}$ and $R^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) $C_{2-20}$ alkenyl; and (27) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The "arylalkyl" group, which as used herein, represents an aryl group, as defined herein, attached to the parent molecular group through an alkylene group, as defined herein. Exemplary unsubstituted arylalkyl groups are from 7 to 30 carbons (e.g., from 7 to 16 or from 7 to 20 carbons, such as $C_{1-6}$ alk-$C_{6-10}$ aryl, $C_{1-10}$ alk-$C_{6-10}$ aryl, or $C_{1-20}$ alk-$C_{6-10}$ aryl). In some embodiments, the alkylene and the aryl each can be further substituted with 1, 2, 3, or 4 substituent groups as defined herein for the respective groups. Other groups preceded by the prefix "alk-" are defined in the same manner, where "alk" refers to a $C_{1-6}$ alkylene, unless otherwise noted, and the attached chemical structure is as defined herein.

The term "azido" represents an —$N_3$ group, which can also be represented as —N=N=N.

The term "bicyclic," as used herein, refer to a structure having two rings, which may be aromatic or non-aromatic. Bicyclic structures include spirocyclyl groups, as defined herein, and two rings that share one or more bridges, where such bridges can include one atom or a chain including two, three, or more atoms. Exemplary bicyclic groups include a bicyclic carbocyclyl group, where the first and second rings are carbocyclyl groups, as defined herein; a bicyclic aryl groups, where the first and second rings are aryl groups, as defined herein; bicyclic heterocyclyl groups, where the first ring is a heterocyclyl group and the second ring is a carbocyclyl (e.g., aryl) or heterocyclyl (e.g., heteroaryl) group; and bicyclic heteroaryl groups, where the first ring is a heteroaryl group and the second ring is a carbocyclyl (e.g., aryl) or heterocyclyl (e.g., heteroaryl) group. In some embodiments, the bicyclic group can be substituted with 1, 2, 3, or 4 substituents as defined herein for cycloalkyl, heterocyclyl, and aryl groups.

The term "boranyl," as used herein, represents —$B(R^{B1})_3$, where each $R^{B1}$ is, independently, selected from the group consisting of H and optionally substituted alkyl. In some embodiments, the boranyl group can be substituted with 1, 2, 3, or 4 substituents as defined herein for alkyl.

The terms "carbocyclic" and "carbocyclyl," as used herein, refer to an optionally substituted $C_{3-12}$ monocyclic, bicyclic, or tricyclic structure in which the rings, which may be aromatic or non-aromatic, are formed by carbon atoms. Carbocyclic structures include cycloalkyl, cycloalkenyl, cycloalkynyl, and aryl groups.

The term "carbonyl," as used herein, represents a C(O) group, which can also be represented as C=O.

The term "carboxy," as used herein, means —$CO_2H$. The term "cyano," as used herein, represents an —CN group.

The term "cycloalkyl," as used herein represents a monovalent saturated or unsaturated non-aromatic cyclic hydrocarbon group from three to eight carbons, unless otherwise specified, and is exemplified by cyclopropyl, cyclobutyl, cyclopentyl, cyclohexyl, cycloheptyl, bicycle heptyl, and the like. When what would otherwise be a cycloalkyl group includes one or more carbon-carbon double bonds, the group is referred to as a "cycloalkenyl" group. For the purposes of this invention, cycloalkenyl excludes aryl groups. When what would otherwise be a cycloalkyl group includes one or more carbon-carbon triple bonds, the group is referred to as a "cycloalkynyl" group. Exemplary cycloalkenyl groups include cyclopentenyl, cyclohexenyl, and the like. The cycloalkyl groups of this invention can be optionally substituted with: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —$(CH_2)_qCO_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —$(CH_2)_q CONR^{B'}R^{C'}$, where q is an integer from zero to four and where $R^{B'}$ and $R^c$ are independently selected from the group consisting of (a) hydrogen, (b) $C_{6-10}$ alkyl, (c) $C_{6-10}$ aryl, and (d) $C_{1-6}$ alk-$C_{6-10}$ aryl; (19) —$(CH_2)_q SO_2 R^{D'}$, where q is an integer from zero to four and where $R^{D'}$ is selected from the group consisting of (a) $C_{6-10}$ alkyl, (b) $C_{6-10}$ aryl, and (c) $C_{1-6}$ alk-$C_{6-10}$ aryl; (20) —$(CH_2)_q SO_2 NR^{E'}R^{F'}$, where q is an integer from zero to four and where each of $R^{E'}$ and $R^{F'}$ is, independently, selected from the group consisting of (a) hydrogen, (b) $C_{6-10}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alk-$C_{1-12}$ heterocyclyl (e.g., $C_{1-6}$ alk-$C_{1-12}$ heteroaryl); (26) oxo; (27) $C_{2-20}$ alkenyl; and (28) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The "cycloalkylalkyl" group, which as used herein, represents a cycloalkyl group, as defined herein, attached to the parent molecular group through an alkylene group, as defined herein (e.g., an alkylene group of from 1 to 4, from 1 to 6, from 1 to 10, or form 1 to 20 carbons). In some embodiments, the alkylene and the cycloalkyl each can be further substituted with 1, 2, 3, or 4 substituent groups as defined herein for the respective group.

The term "halo," as used herein, represents a halogen selected from bromine, chlorine, iodine, or fluorine.

The term "heteroalkyl," as used herein, refers to an alkyl group, as defined herein, in which one or two of the constituent carbon atoms have each been replaced by nitrogen, oxygen, or sulfur. In some embodiments, the heteroalkyl group can be further substituted with 1, 2, 3, or 4 substituent groups as described herein for alkyl groups. The terms "heteroalkenyl" and heteroalkynyl," as used herein refer to alkenyl and alkynyl groups, as defined herein, respectively, in which one or two of the constituent carbon atoms have each been replaced by nitrogen, oxygen, or sulfur. In some embodiments, the heteroalkenyl and heteroalkynyl groups can be further substituted with 1, 2, 3, or 4 substituent groups as described herein for alkyl groups.

Non-limiting examples of optionally substituted heteroalkyl, heteroalkenyl, and heteroalkynyl groups include acyloxy, alkenyloxy, alkoxy, alkoxyalkoxy, alkoxycarbonylalkoxy, alkynyloxy, aminoalkoxy, arylalkoxy, carboxyalkoxy, cycloalkoxy, haloalkoxy, (heterocyclyl)oxy, perfluoroalkoxy, thioalkoxy, and thioheterocyclylalkyl:

The "acyloxy" group, which as used herein, represents an acyl group, as defined herein, attached to the parent molecular group though an oxygen atom (i.e., —O—C(O)—R, where R is H or an optionally substituted $C_{1-6}$, $C_{1-10}$, or $C_{1-20}$ alkyl group). Exemplary unsubstituted acyloxy groups include from 1 to 21 carbons (e.g., from 1 to 7 or from 1 to 11 carbons). In some embodiments, the alkyl group is further substituted with 1, 2, 3, or 4 substituents as described herein.

The "alkenyloxy" group, which as used here, represents a chemical substituent of formula —OR, where R is a $C_{2-20}$ alkenyl group (e.g., $C_{2-6}$ or $C_{2-10}$ alkenyl), unless otherwise specified. Exemplary alkenyloxy groups include ethenyloxy, propenyloxy, and the like. In some embodiments, the alkenyl group can be further substituted with 1, 2, 3, or 4 substituent groups as defined herein (e.g., a hydroxy group).

The "alkoxy" group, which as used herein, represents a chemical substituent of formula —OR, where R is a $C_{1-20}$ alkyl group (e.g., $C_{1-6}$ or $C_{1-10}$ alkyl), unless otherwise specified. Exemplary alkoxy groups include methoxy, ethoxy, propoxy (e.g., n-propoxy and isopropoxy), t-butoxy, and the like. In some embodiments, the alkyl group can be further substituted with 1, 2, 3, or 4 substituent groups as defined herein (e.g., hydroxy or alkoxy).

The "alkoxyalkoxy" group, which as used herein, represents an alkoxy group that is substituted with an alkoxy group. Exemplary unsubstituted alkoxyalkoxy groups include between 2 to 40 carbons (e.g., from 2 to 12 or from 2 to 20 carbons, such as $C_{1-6}$ alkoxy-$C_{1-6}$ alkoxy, $C_{1-10}$ alkoxy-$C_{1-10}$ alkoxy, or $C_{1-20}$ alkoxy-$C_{1-20}$ alkoxy). In some embodiments, the each alkoxy group can be further substituted with 1, 2, 3, or 4 substituent groups as defined herein.

The "alkoxycarbonylalkoxy" group, which as used herein, represents an alkoxy group, as defined herein, that is substituted with an alkoxycarbonyl group, as defined herein (e.g., —O-alkyl-C(O)—OR, where R is an optionally substituted $C_{1-6}$, $C_{1-10}$, or $C_{1-20}$ alkyl group). Exemplary unsubstituted alkoxycarbonylalkoxy include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkoxy, $C_{1-10}$ alkoxycarbonyl-$C_{1-10}$ alkoxy, or $C_{1-20}$ alkoxycarbonyl-$C_{1-20}$ alkoxy). In some embodiments, each alkoxy group is further independently substituted with 1, 2, 3, or 4 substituents, as described herein (e.g., a hydroxy group).

The "alkynyloxy" group, which as used herein, represents a chemical substituent of formula —OR, where R is a $C_{2-20}$ alkynyl group (e.g., $C_{2-6}$ or $C_{2-10}$ alkynyl), unless otherwise specified. Exemplary alkynyloxy groups include ethynyloxy, propynyloxy, and the like. In some embodiments, the alkynyl group can be further substituted with 1, 2, 3, or 4 substituent groups as defined herein (e.g., a hydroxy group).

The "aminoalkoxy" group, which as used herein, represents an alkoxy group, as defined herein, substituted with an amino group, as defined herein. The alkyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl, e.g., carboxy).

The "arylalkoxy" group, which as used herein, represents an alkaryl group, as defined herein, attached to the parent molecular group through an oxygen atom. Exemplary unsubstituted arylalkoxy groups include from 7 to 30 carbons (e.g., from 7 to 16 or from 7 to 20 carbons, such as $C_{6-10}$ aryl-$C_{1-6}$ alkoxy, $C_{6-10}$ aryl-$C_{1-10}$ alkoxy, or $C_{6-10}$ aryl-$C_{1-20}$ alkoxy). In some embodiments, the arylalkoxy group can be substituted with 1, 2, 3, or 4 substituents as defined herein.

The "aryloxy" group, which as used herein, represents a chemical substituent of formula —OR', where R' is an aryl group of 6 to 18 carbons, unless otherwise specified. In some embodiments, the aryl group can be substituted with 1, 2, 3, or 4 substituents as defined herein.

The "carboxyalkoxy" group, which as used herein, represents an alkoxy group, as defined herein, substituted with a carboxy group, as defined herein. The alkoxy group can be further substituted with 1, 2, 3, or 4 substituent groups as described herein for the alkyl group, and the carboxy group can be optionally substituted with one or more O-protecting groups.

The "cycloalkoxy" group, which as used herein, represents a chemical substituent of formula —OR, where R is a $C_{3-8}$ cycloalkyl group, as defined herein, unless otherwise specified. The cycloalkyl group can be further substituted with 1, 2, 3, or 4 substituent groups as described herein.

Exemplary unsubstituted cycloalkoxy groups are from 3 to 8 carbons. In some embodiment, the cycloalkyl group can be further substituted with 1, 2, 3, or 4 substituent groups as described herein.

The "haloalkoxy" group, which as used herein, represents an alkoxy group, as defined herein, substituted with a halogen group (i.e., F, Cl, Br, or I). A haloalkoxy may be substituted with one, two, three, or, in the case of alkyl groups of two carbons or more, four halogens. Haloalkoxy groups include perfluoroalkoxys (e.g., —OCF$_3$), —OCHF$_2$, —OCH$_2$F, —OCCl$_3$, —OCH$_2$CH$_2$Br, —OCH$_2$CH (CH$_2$CH$_2$Br)CH$_3$, and —OCHICH$_3$. In some embodiments, the haloalkoxy group can be further substituted with 1, 2, 3, or 4 substituent groups as described herein for alkyl groups.

The "(heterocyclyl)oxy" group, which as used herein, represents a heterocyclyl group, as defined herein, attached to the parent molecular group through an oxygen atom. In some embodiments, the heterocyclyl group can be substituted with 1, 2, 3, or 4 substituent groups as defined herein.

The "perfluoroalkoxy" group, which as used herein, represents an alkoxy group, as defined herein, where each hydrogen radical bound to the alkoxy group has been replaced by a fluoride radical. Perfluoroalkoxy groups are exemplified by trifluoromethoxy, pentafluoroethoxy, and the like.

The "alkylsulfinyl" group, which as used herein, represents an alkyl group attached to the parent molecular group through an —S(O)— group. Exemplary unsubstituted alkylsulfinyl groups are from 1 to 6, from 1 to 10, or from 1 to 20 carbons. In some embodiments, the alkyl group can be further substituted with 1, 2, 3, or 4 substituent groups as defined herein.

The "thioarylalkyl" group, which as used herein, represents a chemical substituent of formula —SR, where R is an arylalkyl group. In some embodiments, the arylalkyl group can be further substituted with 1, 2, 3, or 4 substituent groups as described herein.

The "thioalkoxy" group as used herein, represents a chemical substituent of formula —SR, where R is an alkyl group, as defined herein. In some embodiments, the alkyl group can be further substituted with 1, 2, 3, or 4 substituent groups as described herein.

The "thioheterocyclylalkyl" group, which as used herein, represents a chemical substituent of formula —SR, where R is an heterocyclylalkyl group. In some embodiments, the heterocyclylalkyl group can be further substituted with 1, 2, 3, or 4 substituent groups as described herein.

The term "heteroaryl," as used herein, represents that subset of heterocyclyls, as defined herein, which are aromatic: i.e., they contain 4n+2 pi electrons within the mono- or multicyclic ring system. Exemplary unsubstituted heteroaryl groups are of 1 to 12 (e.g., 1 to 11, 1 to 10, 1 to 9, 2 to 12, 2 to 11, 2 to 10, or 2 to 9) carbons. In some embodiment, the heteroaryl is substituted with 1, 2, 3, or 4 substituents groups as defined for a heterocyclyl group.

The term "heteroarylalkyl" refers to a heteroaryl group, as defined herein, attached to the parent molecular group through an alkylene group, as defined herein. Exemplary unsubstituted heteroarylalkyl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as C$_{1-6}$ alk-C$_{1-12}$ heteroaryl, C$_{1-10}$ alk-C$_{1-12}$ heteroaryl, or C$_{1-20}$ alk-C$_{1-12}$ heteroaryl). In some embodiments, the alkylene and the heteroaryl each can be further substituted with 1, 2, 3, or 4 substituent groups as defined herein for the respective group. Heteroarylalkyl groups are a subset of heterocyclylalkyl groups.

The term "heterocyclyl," as used herein represents a 5-, 6- or 7-membered ring, unless otherwise specified, containing one, two, three, or four heteroatoms independently selected from the group consisting of nitrogen, oxygen, and sulfur. The 5-membered ring has zero to two double bonds, and the 6- and 7-membered rings have zero to three double bonds. Exemplary unsubstituted heterocyclyl groups are of 1 to 12 (e.g., 1 to 11, 1 to 10, 1 to 9, 2 to 12, 2 to 11, 2 to 10, or 2 to 9) carbons. The term "heterocyclyl" also represents a heterocyclic compound having a bridged multicyclic structure in which one or more carbons and/or heteroatoms bridges two non-adjacent members of a monocyclic ring, e.g., a quinuclidinyl group. The term "heterocyclyl" includes bicyclic, tricyclic, and tetracyclic groups in which any of the above heterocyclic rings is fused to one, two, or three carbocyclic rings, e.g., an aryl ring, a cyclohexane ring, a cyclohexene ring, a cyclopentane ring, a cyclopentene ring, or another monocyclic heterocyclic ring, such as indolyl, quinolyl, isoquinolyl, tetrahydroquinolyl, benzofuryl, benzothienyl and the like. Examples of fused heterocyclyls include tropanes and 1,2,3,5,8,8a-hexahydroindolizine. Heterocyclics include pyrrolyl, pyrrolinyl, pyrrolidinyl, pyrazolyl, pyrazolinyl, pyrazolidinyl, imidazolyl, imidazolinyl, imidazolidinyl, pyridyl, piperidinyl, homopiperidinyl, pyrazinyl, piperazinyl, pyrimidinyl, pyridazinyl, oxazolyl, oxazolidinyl, isoxazolyl, isoxazolidiniyl, morpholinyl, thiomorpholinyl, thiazolyl, thiazolidinyl, isothiazolyl, isothiazolidinyl, indolyl, indazolyl, quinolyl, isoquinolyl, quinoxalinyl, dihydroquinoxalinyl, quinazolinyl, cinnolinyl, phthalazinyl, benzimidazolyl, benzothiazolyl, benzoxazolyl, benzothiadiazolyl, furyl, thienyl, thiazolidinyl, isothiazolyl, triazolyl, tetrazolyl, oxadiazolyl (e.g., 1,2,3-oxadiazolyl), purinyl, thiadiazolyl (e.g., 1,2,3-thiadiazolyl), tetrahydrofuranyl, dihydrofuranyl, tetrahydrothienyl, dihydrothienyl, dihydroindolyl, dihydroquinolyl, tetrahydroquinolyl, tetrahydroisoquinolyl, dihydroisoquinolyl, pyranyl, dihydropyranyl, dithiazolyl, benzofuranyl, isobenzofuranyl, benzothienyl, and the like, including dihydro and tetrahydro forms thereof, where one or more double bonds are reduced and replaced with hydrogens. Still other exemplary heterocyclyls include: 2,3,4,5-tetrahydro-2-oxo-oxazolyl; 2,3-dihydro-2-oxo-1H-imidazolyl; 2,3,4,5-tetrahydro-5-oxo-1H-pyrazolyl (e.g., 2,3,4,5-tetrahydro-2-phenyl-5-oxo-1H-pyrazolyl); 2,3,4,5-tetrahydro-2,4-dioxo-1H-imidazolyl (e.g., 2,3,4,5-tetrahydro-2,4-dioxo-5-methyl-5-phenyl-1H-imidazolyl); 2,3-dihydro-2-thioxo-1,3,4-oxadiazolyl (e.g., 2,3-dihydro-2-thioxo-5-phenyl-1,3,4-oxadiazolyl); 4,5-dihydro-5-oxo-1H-triazolyl (e.g., 4,5-dihydro-3-methyl-4-amino 5-oxo-1H-triazolyl); 1,2,3,4-tetrahydro-2,4-dioxopyridinyl (e.g., 1,2,3,4-tetrahydro-2,4-dioxo-3,3-diethylpyridinyl); 2,6-dioxo-piperidinyl (e.g., 2,6-dioxo-3-ethyl-3-phenylpiperidinyl); 1,6-dihydro-6-oxopyridiminyl; 1,6-dihydro-4-oxopyrimidinyl (e.g., 2-(methylthio)-1,6-dihydro-4-oxo-5-methylpyrimidin-1-yl); 1,2,3,4-tetrahydro-2, 4-dioxopyrimidinyl (e.g., 1,2,3,4-tetrahydro-2,4-dioxo-3-ethylpyrimidinyl); 1,6-dihydro-6-oxo-pyridazinyl (e.g., 1,6-dihydro-6-oxo-3-ethylpyridazinyl); 1,6-dihydro-6-oxo-1,2, 4-triazinyl (e.g., 1,6-dihydro-5-isopropyl-6-oxo-1,2,4-triazinyl); 2,3-dihydro-2-oxo-1H-indolyl (e.g., 3,3-dimethyl-2,3-dihydro-2-oxo-1H-indolyl and 2,3-dihydro-2-oxo-3,3'-spiropropane-1H-indol-1-yl); 1,3-dihydro-1-oxo-2H-iso-indolyl; 1,3-dihydro-1,3-dioxo-2H-iso-indolyl; 1H-benzopyrazolyl (e.g., 1-(ethoxycarbonyl)-1H-benzopyrazolyl); 2,3-dihydro-2-oxo-1H-benzimidazolyl (e.g., 3-ethyl-2,3-dihydro-2-oxo-1H-benzimidazolyl); 2,3-dihydro-2-oxo-benzoxazolyl (e.g., 5-chloro-2,3-dihydro-2-oxo-benzoxazolyl); 2,3-dihydro-2-oxo-benzoxazolyl;

2-oxo-2H-benzopyranyl; 1,4-benzodioxanyl; 1,3-benzodioxanyl; 2,3-dihydro-3-oxo,4H-1,3-benzothiazinyl; 3,4-dihydro-4-oxo-3H-quinazolinyl (e.g., 2-methyl-3,4-dihydro-4-oxo-3H-quinazolinyl); 1,2,3,4-tetrahydro-2,4-dioxo-3H-quinazolyl (e.g., 1-ethyl-1,2,3,4-tetrahydro-2,4-dioxo-3H-quinazolyl); 1,2,3,6-tetrahydro-2,6-dioxo-7H-purinyl (e.g., 1,2,3,6-tetrahydro-1,3-dimethyl-2,6-dioxo-7H-purinyl); 1,2,3,6-tetrahydro-2,6-dioxo-1H-purinyl (e.g., 1,2,3,6-tetrahydro-3,7-dimethyl-2,6-dioxo-1H-purinyl); 2-oxobenz[c,d]indolyl; 1,1-dioxo-2H-naphth[1,8-c,d]isothiazolyl; and 1,8-naphthylenedicarboxamido. Additional heterocyclics include 3,3a,4,5,6,6a-hexahydro-pyrrolo[3,4-b]pyrrol-(2H)-yl, and 2,5-diazabicyclo[2.2.1]heptan-2-yl, homopiperazinyl (or diazepanyl), tetrahydropyranyl, dithiazolyl, benzofuranyl, benzothienyl, oxepanyl, thiepanyl, azocanyl, oxecanyl, and thiocanyl. Heterocyclic groups also include groups of the formula

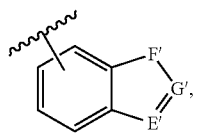

where

E' is selected from the group consisting of —N— and —CH—; F' is selected from the group consisting of —N=CH, —NH—CH$_2$—, —NH—C(O)—, —NH—, —CH=N—CH$_2$—NH—, —C(O)—NH—, —CH=CH—, —CH$_2$—, —CH$_2$CH$_2$—, —CH$_2$O—, —OCH$_2$—, —O—, and —S—; and G' is selected from the group consisting of —CH— and —N—. Any of the heterocyclyl groups mentioned herein may be optionally substituted with one, two, three, four or five substituents independently selected from the group consisting of: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{1-20}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alk-$C_{6-10}$ aryl; (8) azido; (9) $C_{3-8}$ cycloalkyl; (10) $C_{1-6}$ alk-$C_{3-8}$ cycloalkyl; (11) halo; (12) $C_{1-12}$ heterocyclyl (e.g., $C_{2-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —(CH$_2$)$_q$CO$_2$R$^{A'}$, where q is an integer from zero to four, and R$^{A'}$ is selected from the group consisting of (a) $C_{1-6}$ alkyl, (b) $C_{6-10}$ aryl, (c) hydrogen, and (d) $C_{1-6}$ alk-$C_{6-10}$ aryl; (18) —(CH$_2$)$_q$CONR$^{B'}$R$^{C'}$, where q is an integer from zero to four and where R$^{B'}$ and R$^{C'}$ are independently selected from the group consisting of (a) hydrogen, (b) $C_{1-6}$ alkyl, (c) $C_{6-10}$ aryl, and (d) $C_{1-6}$ alk-$C_{6-10}$ aryl; (19) —(CH$_2$)$_q$SO$_2$R$^{D'}$, where q is an integer from zero to four and where R$^{D'}$ is selected from the group consisting of (a) $C_{1-6}$ alkyl, (b) $C_{6-10}$ aryl, and (c) $C_{1-6}$ alk-$C_{6-10}$ aryl; (20) —(CH$_2$)$_q$SO$_2$NR$^{E'}$R$^{F'}$, where q is an integer from zero to four and where each of R$^{E'}$ and R$^{F'}$ is, independently, selected from the group consisting of (a) hydrogen, (b) $C_{1-6}$ alkyl, (c) $C_{6-10}$ aryl, and (d) $C_{1-6}$ alk-$C_{6-10}$ aryl; (21) thiol; (22) $C_{6-10}$ aryloxy; (23) $C_{3-8}$ cycloalkoxy; (24) arylalkoxy; (25) $C_{1-6}$ alk-$C_{1-12}$ heterocyclyl (e.g., $C_{1-6}$ alk-$C_{1-12}$ heteroaryl); (26) oxo; (27) ($C_{1-12}$ heterocyclyl) imino; (28) $C_{2-20}$ alkenyl; and (29) $C_{2-20}$ alkynyl. In some embodiments, each of these groups can be further substituted as described herein. For example, the alkylene group of a $C_1$-alkaryl or a $C_1$-alkheterocyclyl can be further substituted with an oxo group to afford the respective aryloyl and (heterocyclyl)oyl substituent group.

The "heterocyclylalkyl" group, as used herein, represents a heterocyclyl group, as defined herein, attached to the parent molecular group through an alkylene group, as defined herein. Exemplary unsubstituted heterocyclylalkyl groups are from 2 to 32 carbons (e.g., from 2 to 22, from 2 to 18, from 2 to 17, from 2 to 16, from 3 to 15, from 2 to 14, from 2 to 13, or from 2 to 12 carbons, such as $C_{1-6}$ alk-$C_{1-12}$ heterocyclyl, $C_{1-10}$ alk-$C_{1-12}$ heterocyclyl, or $C_{1-20}$ alk-$C_{1-12}$ heterocyclyl). In some embodiments, the alkylene and the heterocyclyl each can be further substituted with 1, 2, 3, or 4 substituent groups as defined herein for the respective group.

The term "hydrocarbon," as used herein, represents a group consisting only of carbon and hydrogen atoms.

The term "hydroxy," as used herein, represents an —OH group.

The term "N-protected amino," as used herein, refers to an amino group, as defined herein, to which is attached one or two N-protecting groups, as defined herein.

The term "N-protecting group," as used herein, represents those groups intended to protect an amino group against undesirable reactions during synthetic procedures. Commonly used N-protecting groups are disclosed in Greene, "Protective Groups in Organic Synthesis," 3$^{rd}$ Edition (John Wiley & Sons, New York, 1999), which is incorporated herein by reference. N-protecting groups include acyl, aryloyl, or carbamyl groups such as formyl, acetyl, propionyl, pivaloyl, t-butylacetyl, 2-chloroacetyl, 2-bromoacetyl, trifluoroacetyl, trichloroacetyl, phthalyl, o-nitrophenoxyacetyl, α-chlorobutyryl, benzoyl, 4-chlorobenzoyl, 4-bromobenzoyl, 4-nitrobenzoyl, and chiral auxiliaries such as protected or unprotected D, L or D, L-amino acids such as alanine, leucine, phenylalanine, and the like; sulfonyl-containing groups such as benzenesulfonyl, p-toluenesulfonyl, and the like; carbamate forming groups such as benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-methoxybenzyloxycarbonyl, 2-nitro-4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxy carbonyl, t-butyloxycarbonyl, diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxy carbonyl, fluorenyl-9-methoxycarbonyl, cyclopentyloxycarbonyl, adamantyloxycarbonyl, cyclohexyloxycarbonyl, phenylthiocarbonyl, and the like, alkaryl groups such as benzyl, triphenylmethyl, benzyloxymethyl, and the like and silyl groups, such as trimethylsilyl, and the like. Preferred N-protecting groups are formyl, acetyl, benzoyl, pivaloyl, t-butylacetyl, alanyl, phenylsulfonyl, benzyl, t-butyloxycarbonyl (Boc), and benzyloxycarbonyl (Cbz).

The term "nitro," as used herein, represents an —NO$_2$ group.

The term "O-protecting group," as used herein, represents those groups intended to protect an oxygen containing (e.g., phenol, hydroxyl, or carbonyl) group against undesirable reactions during synthetic procedures. Commonly used 0-protecting groups are disclosed in Greene, "Protective Groups in Organic Synthesis," 3$^{rd}$ Edition (John Wiley & Sons, New York, 1999), which is incorporated herein by reference. Exemplary O-protecting groups include acyl, aryloyl, or carbamyl groups, such as formyl, acetyl, propionyl, pivaloyl, t-butylacetyl, 2-chloroacetyl, 2-bromoacetyl, trifluoroacetyl, trichloroacetyl, phthalyl, o-nitrophenoxyacetyl, α-chlorobutyryl, benzoyl, 4-chlorobenzoyl, 4-bromobenzoyl, t-butyldimethylsilyl, tri-iso-propylsilyloxymethyl, 4,4'-dimethoxytrityl, isobutyryl, phenoxyacetyl, 4-isopropylpehenoxyacetyl, dimethylformamidino, and 4-nitrobenzoyl; alkylcarbonyl groups, such as acyl, acetyl, propionyl, pivaloyl, and the like; optionally substituted arylcarbonyl groups, such as benzoyl; silyl groups, such as trimethylsilyl (TMS), tert-butyldimethylsilyl (TBDMS), tri-iso-propylsilyloxymethyl (TOM), triisopropylsilyl (TIPS), and the like; ether-forming groups with the hydroxyl, such methyl, methoxymethyl, tetrahydropyranyl, benzyl, p-methoxybenzyl, trityl, and the like; alkoxycarbonyls, such as methoxycarbonyl, ethoxycarbonyl, isopropoxycarbonyl, n-isopropoxycarbonyl, n-butyloxycarbonyl, isobutyloxycarbonyl, sec-butyloxycarbonyl, t-butyloxycarbonyl, 2-ethylhexyloxycarbonyl, cyclohexyloxycarbonyl, methyloxycarbonyl, and the like; alkoxyalkoxycarbonyl groups, such as methoxymethoxycarbonyl, ethoxymethoxycarbonyl, 2-methoxyethoxycarbonyl, 2-ethoxyethoxycarbonyl, 2-butoxyethoxycarbonyl, 2-methoxyethoxymethoxycarbonyl, allyloxycarbonyl, propargyloxycarbonyl, 2-butenoxycarbonyl, 3-methyl-2-butenoxycarbonyl, and the like; haloalkoxycarbonyls, such as 2-chloroethoxycarbonyl, 2-chloroethoxycarbonyl, 2,2,2-trichloroethoxycarbonyl, and the like; optionally substituted arylalkoxycarbonyl groups, such as benzyloxycarbonyl, p-methylbenzyloxycarbonyl, p-methoxybenzyloxycarbonyl, p-nitrobenzyloxycarbonyl, 2,4-dinitrobenzyloxycarbonyl, 3,5-dimethylbenzyloxycarbonyl, p-chlorobenzyloxycarbonyl, p-bromobenzyloxycarbonyl, fluorenylmethyloxycarbonyl, and the like; and optionally substituted aryloxycarbonyl groups, such as phenoxycarbonyl, p-nitrophenoxycarbonyl, o-nitrophenoxycarbonyl, 2,4-dinitrophenoxycarbonyl, p-methyl-phenoxycarbonyl, m-methylphenoxycarbonyl, o-bromophenoxycarbonyl, 3,5-dimethylphenoxycarbonyl, p-chlorophenoxycarbonyl, 2-chloro-4-nitrophenoxy-carbonyl, and the like); substituted alkyl, aryl, and alkaryl ethers (e.g., trityl; methylthiomethyl; methoxymethyl; benzyloxymethyl; siloxymethyl; 2,2,2,-trichloroethoxymethyl; tetrahydropyranyl; tetrahydrofuranyl; ethoxyethyl; 1-[2-(trimethylsilyl)ethoxy]ethyl; 2-trimethylsilylethyl; t-butyl ether; p-chlorophenyl, p-methoxyphenyl, p-nitrophenyl, benzyl, p-methoxybenzyl, and nitrobenzyl); silyl ethers (e.g., trimethylsilyl; triethylsilyl; triisopropylsilyl; dimethylisopropylsilyl; t-butyldimethylsilyl; t-butyldiphenylsilyl; tribenzylsilyl; triphenylsilyl; and diphenylmethylsilyl); carbonates (e.g., methyl, methoxymethyl, 9-fluorenylmethyl; ethyl; 2,2,2-trichloroethyl; 2-(trimethylsilyl)ethyl; vinyl, allyl, nitrophenyl; benzyl; methoxybenzyl; 3,4-dimethoxybenzyl; and nitrobenzyl); carbonyl-protecting groups (e.g., acetal and ketal groups, such as dimethyl acetal, 1,3-dioxolane, and the like; acylal groups; and dithiane groups, such as 1,3-dithianes, 1,3-dithiolane, and the like); carboxylic acid-protecting groups (e.g., ester groups, such as methyl ester, benzyl ester, t-butyl ester, orthoesters, and the like; and oxazoline groups.

The term "oxo" as used herein, represents =O.

The prefix "perfluoro," as used herein, represents any group, as defined herein, where each hydrogen radical bound to the alkyl group has been replaced by a fluoride radical. For example, perfluoroalkyl groups are exemplified by trifluoromethyl, pentafluoroethyl, and the like.

The term "protected hydroxyl," as used herein, refers to an oxygen atom bound to an O-protecting group.

The term "spirocyclyl," as used herein, represents a $C_{2-7}$ alkylene diradical, both ends of which are bonded to the same carbon atom of the parent group to form a spirocyclic group, and also a $C_{1-6}$ heteroalkylene diradical, both ends of which are bonded to the same atom. The heteroalkylene radical forming the spirocyclyl group can containing one, two, three, or four heteroatoms independently selected from the group consisting of nitrogen, oxygen, and sulfur. In some embodiments, the spirocyclyl group includes one to seven carbons, excluding the carbon atom to which the diradical is attached. The spirocyclyl groups of the invention may be optionally substituted with 1, 2, 3, or 4 substituents provided herein as optional substituents for cycloalkyl and/or heterocyclyl groups.

The term "sulfonyl," as used herein, represents an —S(O)$_2$— group.

The term "thiol," as used herein represents an —SH group.

Chimera: As used herein, "chimera" is an entity having two or more incongruous or heterogeneous parts or regions.

Chimeric polynucleotide: As used herein, "chimeric polynucleotides" are those nucleic acid polymers having portions or regions which differ in size and/or chemical modification pattern, chemical modification position, chemical modification percent or chemical modification population and combinations of the foregoing.

Compound: As used herein, the term "compound," is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an polynucleotide or polypeptide or may apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention may be single units or multimers or comprise one or more components of a complex or higher order structure.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of a polynucleotide to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Differentiated cell: As used herein, the term "differentiated cell" refers to any somatic cell that is not, in its native form, pluripotent. Differentiated cell also encompasses cells that are partially differentiated.

Differentiation: As used herein, the term "differentiation factor" refers to a developmental potential altering factor such as a protein, RNA or small molecule that can induce a cell to differentiate to a desired cell-type.

Differentiate: As used herein, "differentiate" refers to the process where an uncommitted or less committed cell acquires the features of a committed cell.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Dose splitting factor (DSF)-ratio of PUD of dose split treatment divided by PUD of total daily dose or single unit dose. The value is derived from comparison of dosing regimens groups.

Enantiomer: As used herein, the term "enantiomer" means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

Encapsulate: As used herein, the term "encapsulate" means to enclose, surround or encase.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

Exosome: As used herein, "exosome" is a vesicle secreted by mammalian cells or a complex involved in RNA degradation.

Expression: As used herein, "expression" of a nucleic acid sequence refers to one or more of the following events: (1)

production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a polynucleotide of a NAV and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna. CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Infectious Agent: As used herein, the phrase "infectious agent" means an agent capable of producing an infection in an organism, for example, in an animal. An infectious agent may refer to any microorganism, virus, infectious substance, or biological product that may be engineered as a result of biotechnology, or any naturally occurring or bioengineered component of any such microorganism, virus, infectious substance, or biological product, can cause emerging and contagious disease, death or other biological malfunction in a human, an animal, a plant or another living organism.

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

Influenza: As used herein, "influenza" or "flu" is an infectious disease of birds and mammals caused by RNA viruses of the family Orthomyxoviridae, the influenza viruses.

Isomer: As used herein, the term "isomer" means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

IVT Polynucleotide: As used herein, an "IVT polynucleotide" is a linear polynucleotide which may be made using in vitro transcription (IVT) enzymatic synthesis methods.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally. In one embodiment, the polynucleotide molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Neutralizing antibody: As used herein, a "neutralizing antibody" refers to an antibody which binds to its antigen and defends a cell from an antigen or infectious agent by neutralizing or abolishing any biological activity it has.

Non-human vertebrate: As used herein, a "non human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic Acid Vaccine: As used herein, "nucleic acid vaccine" or "NAV" or "NAV composition" refers to a vaccine or vaccine composition which includes a nucleic acid or nucleic acid molecule (e.g., a polynucleotide) encoding an antigen (e.g., an antigenic protein or polypeptide.) In exemplary embodiments, a nucleic acid vaccine or NAV includes a ribonucleic ("RNA") polynucleotide, ribonucleic acid ("RNA") or ribonucleic acid ("RNA") molecule. Such embodiments can be referred to as ribonucleic acid ("RNA") vaccines (RNAVs). In preferred embodiments, a nucleic acid vaccine or NAV includes a messenger RNA ("mRNA") polynucleotide, messenger RNA ("mRNA") or messenger RNA ("mRNA") molecule as described in detail herein. Such embodiments can be referred to as messenger RNA ("mRNA") vaccines (mRNAVs).

Off-target: As used herein, "off target" refers to any unintended effect on any one or more target, gene, or cellular transcript.

Open reading frame: As used herein, the term "open reading frame" or "ORF" refers to a continuous polynucleotide sequence, for example, a DNA sequence or RNA sequence (e.g., an mRNA sequence), comprising a start codon, a subsequent region comprising a plurality of amino acid-encoding codons, and a terminal stop codon, wherein the region comprising the plurality of amino acid-encoding codons contains no stop codons.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

Part: As used herein, a "part" or "region" of a polynucleotide is defined as any portion of the polynucleotide which is less than the entire length of the polynucleotide.

Peptide: As used herein, "peptide" is less than or equal to 50 amino acids long, e.g., about 5, 10, 15, 20, 25, 30, 35, 40, 45, or 50 amino acids long.

Paratope: As used herein, a "paratope" refers to the antigen-binding site of an antibody.

Patient: As used herein, "patient" refers to a subject who may seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune phrophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3 \psi$), and 2'-O-methyl-pseudouridine ($\psi m$).

Purified: As used herein, "purify," "purified," "purification" means to make substantially pure or clear from unwanted components, material defilement, admixture or imperfection.

Repeated transfection: As used herein, the term "repeated transfection" refers to transfection of the same cell culture with a polynucleotide a plurality of times. The cell culture can be transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Stereoisomer: As used herein, the term "stereoisomer" refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present invention may be chemical or enzymatic.

Vaccine: As used herein, a vaccine is a compound or composition which comprises at least one polynucleotide encoding at least one antigen.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Transfection: As used herein, the term "transfection" refers to methods to introduce exogenous nucleic acids into a cell. Methods of transfection include, but are not limited to, chemical methods, physical treatments and cationic lipids or mixtures.

Translation: As used herein "translation" is the process by which a polynucleotide molecule is processed by a ribosome or ribosomal-like machinery, e.g., cellular or artificial, to produce a peptide or polypeptide.

Transcription: As used herein "transcription" is the process by which a polynucleotide molecule is processed by a polymerase or other enzyme to produce a polynucleotide, e.g., an RNA polynucleotide.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. Treatment may be administered to a subject who does not exhibit signs of a disease, infection, disorder, and/or condition and/or to a subject who exhibits only early signs of a disease, infection, disorder, and/or condition for the purpose of decreasing the risk of developing pathology associated with the disease, infection, disorder, and/or condition.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

Vaccine: As used herein, the phrase "vaccine" refers to a biological preparation that improves immunity in the context of a particular disease, disorder or condition.

Viral protein: As used herein, the phrase "viral protein" means any protein originating from a virus.

Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1. Manufacture of Polynucleotides

According to the present invention, the manufacture of polynucleotides and or parts or regions thereof may be accomplished utilizing the methods taught in U.S. Ser. No. 61/800,049 filed Mar. 15, 2013 entitled "Manufacturing Methods for Production of RNA Transcripts", the contents of which is incorporated herein by reference in its entirety.

Purification methods may include those taught in U.S. Provisional Patent Application No. 61/799,872, U.S. Provisional Patent Application No. 61/794,842, U.S. Provisional Patent Application 61/800,326, each of which is incorporated herein by reference in its entirety.

Detection and characterization methods of the polynucleotides may be performed as taught in U.S. Provisional Patent Application No. 61/799,780 and U.S. Provisional Patent Application No. 61/798,945, each of which is incorporated herein by reference in its entirety.

Characterization of the polynucleotides of the invention may be accomplished using a procedure selected from the group consisting of polynucleotide mapping, reverse transcriptase sequencing, charge distribution analysis, and detection of RNA impurities, wherein characterizing comprises determining the RNA transcript sequence, determining the purity of the RNA transcript, or determining the charge heterogeneity of the RNA transcript. Such methods are taught in, for example, US Provisional Patent Application No. 61/799,905 and U.S. Provisional Patent Application No. 61/800,110, the contents of each of which is incorporated herein by reference in its entirety.

Example 2. Chimeric Polynucleotide Synthesis

Introduction

According to the present invention, two regions or parts of a chimeric polynucleotide may be joined or ligated using triphosphate chemistry.

According to this method, a first region or part of 100 nucleotides or less is chemically synthesized with a 5' monophosphate and terminal 3'desOH or blocked OH. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 130 nucleotides may be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then it is preferable that such region or part comprise a phosphate-sugar backbone.

Ligation is then performed using any known click chemistry, orthoclick chemistry, solulink, or other bioconjugate chemistries known to those in the art.

Synthetic Route

The chimeric polynucleotide is made using a series of starting segments. Such segments include:
(a) Capped and protected 5' segment comprising a normal 3'OH (SEG. 1)
(b) 5' triphosphate segment which may include the coding region of a polypeptide and comprising a normal 3'OH (SEG. 2)
(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) is treated with cordycepin and then with pyrophosphatase to create the 5'monophosphate.

Segment 2 (SEG. 2) is then ligated to SEG. 3 using RNA ligase. The ligated polynucleotide is then purified and treated with pyrophosphatase to cleave the diphosphate. The treated SEG.2-SEG. 3 construct is then purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3. PCR for cDNA Production

PCR procedures for the preparation of cDNA are performed using 2× KAPA HIFI™ HotStart ReadyMix by Kapa Biosystems (Woburn, Mass.). This system includes 2×KAPA ReadyMix12.5 µl; Forward Primer (10 uM) 0.75 µl; Reverse Primer (10 uM) 0.75 µl; Template cDNA –100 ng; and dH$_2$O diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant invention incorporates a poly-T$_{120}$ for a poly-A$_{120}$ in the mRNA. Other reverse primers with longer or shorter poly(T) tracts can be used to adjust the length of the poly(A) tail in the polynucleotide mRNA.

The reaction is cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 4. In Vitro Transcription (IVT)

The in vitro transcription reaction generates polynucleotides containing uniformly modified polynucleotides. Such uniformly modified polynucleotides may comprise a region or part of the polynucleotides of the invention. The input nucleotide triphosphate (NTP) mix is made in-house using natural and un-natural NTPs.

A typical in vitro transcription reaction includes the following:

| 1 | Template cDNA | 1.0 µg |
|---|---|---|
| 2 | 10× transcription buffer (400 mM Tris-HCl pH 8.0, 190 mM MgCl$_2$, 50 mM DTT, 10 mM Spermidine) | 2.0 µl |
| 3 | Custom NTPs (25 mM each) | 7.2 µl |
| 4 | RNase Inhibitor | 20 U |
| 5 | T7 RNA polymerase | 3000 U |
| 6 | dH$_2$0 | Up to 20.0 µl. and |
| 7 | Incubation at 37° C. for 3 hr-5 hrs. | |

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 µg of RNA. Following the cleanup, the RNA is quantified using the NanoDrop and analyzed by agarose gel electrophoresis to confirm the RNA is the proper size and that no degradation of the RNA has occurred.

Example 5. Enzymatic Capping

Capping of a polynucleotide is performed as follows where the mixture includes: IVT RNA 60 µg-180 µg and dH$_2$O up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The polynucleotide is then purified using Ambion's MEGACLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 6. PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5 M Tris-HCl (pH 8.0), 2.5 M NaCl, 100 mM MgCl$_2$)(12.0 µl); 20 mM ATP (6.0 µl); Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGA-CLEAR™ kit (Austin, Tex.) (up to 500 µg). Poly-A Polymerase is preferably a recombinant enzyme expressed in yeast.

It should be understood that the processivity or integrity of the polyA tailing reaction may not always result in an exact size polyA tail. Hence polyA tails of approximately between 40-200 nucleotides, e.g, about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the invention.

Example 7. Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5') ppp(5')A; G(5')ppp(5')G; m7G(5')ppp(5')A; m7G(5')ppp (5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8. Capping Assays

A. Protein Expression Assay

Polynucleotides encoding a polypeptide, containing any of the caps taught herein can be transfected into cells at equal concentrations. 6, 12, 24 and 36 hours post-transfection the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein can be transfected into cells at multiple concentrations. 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to a polynucleotides containing an immune-activating cap structure.

D. Capping Reaction Efficiency

Polynucleotides encoding a polypeptide, containing any of the caps taught herein can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 9. Agarose Gel Electrophoresis of Modified RNA or RT PCR Products

Individual polynucleotides (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 10. Nanodrop Modified RNA Quantification and UV Spectral Data

Modified polynucleotides in TE buffer (1 µl) are used for Nanodrop UV absorbance readings to quantitate the yield of each polynucleotide from an chemical synthesis or in vitro transcription reaction.

Example 11. Formulation of Modified mRNA Using Lipidoids

Polynucleotides are formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may used as a starting point. After formation of the particle, polynucleotide is added and allowed to integrate with the complex. The encapsulation efficiency is determined using a standard dye exclusion assays.

Example 12. Method of Screening for Protein Expression

A. Electrospray Ionization

A biological sample which may contain proteins encoded by a polynucleotide administered to the subject is prepared and analyzed according to the manufacturer protocol for electrospray ionization (ESI) using 1, 2, 3 or 4 mass analyzers. A biologic sample may also be analyzed using a tandem ESI mass spectrometry system.

Patterns of protein fragments, or whole proteins, are compared to known controls for a given protein and identity is determined by comparison.

B. Matrix-Assisted Laser Desorption/Ionization

A biological sample which may contain proteins encoded by one or more polynucleotides administered to the subject is prepared and analyzed according to the manufacturer protocol for matrix-assisted laser desorption/ionization (MALDI).

Patterns of protein fragments, or whole proteins, are compared to known controls for a given protein and identity is determined by comparison.

C. Liquid Chromatography-Mass spectrometry-Mass spectrometry

A biological sample, which may contain proteins encoded by one or more polynucleotides, may be treated with a trypsin enzyme to digest the proteins contained within. The resulting peptides are analyzed by liquid chromatography-mass spectrometry-mass spectrometry (LC/MS/MS). The peptides are fragmented in the mass spectrometer to yield diagnostic patterns that can be matched to protein sequence databases via computer algorithms. The digested sample may be diluted to achieve 1 ng or less starting material for a given protein. Biological samples containing a simple buffer background (e.g. water or volatile salts) are amenable to direct in-solution digest; more complex backgrounds (e.g. detergent, non-volatile salts, glycerol) require an additional clean-up step to facilitate the sample analysis.

Patterns of protein fragments, or whole proteins, are compared to known controls for a given protein and identity is determined by comparison.

Example 13. Cyclization and/or Concatemerization

According to the present invention, a polynucleotide may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, 1 µg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split polynucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

Example 14. Antigen Polynucleotides

Polynucleotides used in the studies herein which encode certain infectious agent antigens or variants thereof are shown in Table 28.

TABLE 28

Antigen polynucleotides (RNA vaccine)

| Construct Number | Gene ID | Description | Construct |
|---|---|---|---|
| 1 | 120552 | Flu PR8 HA ferritin | HAPR8__Ferritin__Hs3 |
| 2 | 120553 | flu 1999NC HA ferritin | HA1999NC__Ferritin__Hs3 |
| 3 | 125387 | H5N1 HA antigen | H5N1__HA__NIBRG-14 |
| 4 | 125388 | H1N1 PR8 HA antigen with MT 5U TABLE 28-continued Antigen polynucleotides (RNA vaccine)

| Construct Number | Gene ID | Description | Construct |
|---|---|---|---|
| 13 | 136473 | flu HA antigen | A/duck/Anhui/SC702/2013(H7N9)__Hs3U |
| 14 | 136754 | *C diff* antigen | Cdiff__toxinA.truc__nMyc.cFLAG__Hs3U |
| 15 | 136755 | *C diff* antigen | Cdiff__toxinB.truc__nMyc.cFLAG__Hs3U |
| 16 | 136756 | *C diff* antigen | Cdiff__cdtA.truc__nMyc.cFLAG__Hs3U |
| 17 | 136757 | *C diff* antigen | Cdiff__cdtB.truc__nMyc.cFLAG__Hs3U |
| 18 | 120554 | Dengue strain 2 domain 3 ferritin | DEN2__DIII__Ferritin__Hs3 |
| 19 | 120555 | Dengue strain 3 domain 3 ferritin | DEN3__DIII__Ferritin__Hs3 |
| 20 | 120556 | Dengue strain 4 domain 3 ferritin | DEN4__DIII__Ferritin__Hs3 |
| 21 | 120557 | dengue strain 1-4 Domain 3 | Dengue__TDIII__Hs3 |
| 22 | 121542 | Dengue strain 1 domain 3 ferritin | DEN1__DIII__Ferritin__Corr__Hs3 |
| 23 | 131502 | Dengue 2, D2Y98P strain, PrME transmembrane antigen | DEN2__D2Y98P__PrME__Hs3 |
| 24 | 131503 | Dengue 2, D2Y98P strain, PrME secreted antigen | DEN2__D2Y98P__PrME80__Hs3 |
| 25 | 131507 | Dengue 2, D2Y98P strain, PrME secreted antigen with dendritic targeting ScFv against mouse DEC205 | DEN2__D2Y98P__PrME80__ScFv.aDEC205.FLAG__Hs3 |
| 26 | 136358 | *Staph aureus* antigen | SpA__sec.D.wt.nXpress.cHA__VKsp__Hs3U |
| 27 | 136359 | *Staph aureus* antigen | SpA__intra.D.kkaa.nFLAG.cMyc__Hs3U |
| 28 | 136360 | *Staph aureus* antigen | SpA__mem.D.kkaa.nFLAG.cMyc__CD28mem__Hs3U |
| 29 | 136361 | *Staph aureus* antigen | SpA__sec.D.kkaa.nFLAG.cMyc__VKsp__Hs3U |
| 30 | 136362 | *Staph aureus* antigen | SpA__intra.D.wt.nXpress.cHA__Hs3U |
| 31 | 136363 | *Staph aureus* antigen | SpA__mem.D.wt.nXpress.cHA__CD28mem__Hs3U |
| 32 | 136364 | *Staph aureus* antigen | SpA__sec.D.wt__VKsp |
| 33 | 136758 | MRSA IsdA antigen | MRSA__IsdA.truc__nMyc.cFLAG__Hs3U |
| 34 | 136759 | MRSA IsdB antigen | MRSA__IsdB.truc__nMyc.cFLAG__Hs3U |
| 35 | 136763 | MRSA SDRD antigen | MRSA__sdrd.trac__nMyc.cFLAG__Hs3U |
| 36 | 136764 | MRSA SDRE antigen | MRSA__sdre.truc__nMyc.cFLAG__Hs3U |
| 37 | 136765 | MRSA MECA antigen | MRSA__mecA.truc__nMyc.cFLAG__Hs3U |
| 38 | 139325 | MRSA SDRD antigen | MRSA__sdrd.contig1.__FLAG__Hs3U |
| 39 | 139326 | MRSA SDRD antigen | MRSA__sdrd.Contig2.__FLAG__Hs3U |
| 40 | 139327 | MRSA SDRE antigen | MRSA__sdre.Contig1.__FLAG__Hs3U |
| 41 | 139328 | MRSA SDRE antigen | MRSA__sdre.Contig2.__FLAG__Hs3U |
| 42 | 140470 | MRSA ISDA antigen | MRSA__IsdA.fl__FLAG__Hs3U |
| 43 | 139277 | MRSA MECA antigen | MRSA__mecA.fl.__FLAG__Hs3U |
| 44 | 136747 | ETEC antigen | ETEC.eltA(S63K/R192G/L211A)__nMyc.cFLAG__Hs3U |
| 45 | 136748 | ETEC antigen | ETEC.eltB__nMyc.cFLAG__Hs3U |
| 46 | 136749 | ETEC antigen | ETEC.Sta3(A14Q)__nMyc.cFLAG__Hs3U |
| 47 | 136750 | ETEC antigen | ETEC.etpA.__nMyc.cFLAG__Hs3U |
| 48 | 136751 | ETEC antigen | ETEC.etpB.__nMyc.cFLAG__Hs3U |
| 49 | 136752 | ETEC antigen | ETEC.EatA__nMyc.cFLAG__Hs3U |
| 50 | 136753 | ETEC antigen | ETEC__cssA__nMyc.cFLAG__Hs3U |
| 51 | 136747 | ETEC antigen | ETEC.eltA(S63K/R192G/L211A)__nMyc.cFLAG__Hs3U |

TABLE 28-continued

Antigen polynucleotides (RNA vaccine)

| Construct Number | Gene ID | Description | Construct |
|---|---|---|---|
| 52 | 142544 | ETEC antigen | ETEC.etpB.fl__FLAG__Hs3U |
| 53 | 136749 | ETEC antigen | ETEC.Sta3(A14Q)__nMyc.cFLAG__Hs3U |
| 54 | 136753 | ETEC CSSA antigen | ETEC__cssA__nMyc.cFLAG__Hs3U |
| 55 | 139323 | ETEC EATA antigen | ETEC__EatA.contig1.__FLAG__Hs3U |
| 56 | 139324 | ETEC EATA antigen | ETEC__EatA.contig2.__FLAG__Hs3U |
| 57 | 139321 | ETEC EPTA antigen | ETEC__eptA.contig1.__FLAG__Hs3U |
| 58 | 139322 | ETEC ETPA antigen | ETEC__etpA.contig2.__FLAG__Hs3U |
| 59 | 136760 | Tuberculosis antigen | TB__Ag85A__nMyc.cFLAG__Hs3U |
| 60 | 136761 | Tuberculosis antigen | TB__Ag85B__nMyc.cFLAG__Hs3U |
| 61 | 136762 | Tuberculosis antigen | TB__TB10.4__nMyc.cFLAG__Hs3U |
| 62 | 136335 | Cholera toxin B | CholeraToxB.H78A.FLAG__VKsp__Hs3U |
| 63 | 144097 | vaccine Influenza HA antigen (nanoscaffold) | PR8HA.Stalk.pscaffold__Hs3U |
| 64 | 144094 | vaccine Influenza HA antigen (splitcore) | PR8HA.stalk.HbCore.monoRNA__Hs3U |
| 65 | 144095 | vaccine Influenza HA antigen (splitcore) | PR8HA.stalk.HbCoreC.RKR__Hs3U |
| 66 | 144096 | vaccine Influenza HA antigen (splitcore) | PR8HA.stalk.HbCoreN.RKR__Hs3U |
| 67 | 144098 | vaccine Influenza HA antigen; aglycosylated | PR8HA.headless.Stalk.ugly(N76D/N270D)__Hs3U |
| 68 | 144099 | vaccine Influenza HA antigen; aglycosylated | PR8HA.headless.Stalk.ugly(N27D/N28D/N40D/N76D/N270D)__Hs3U |
| 69 | 150088 | Vaccine MERS CoV spike protein (V5 epitope tagged) | MERS-CoV__ProteinS/EMC/2012.V5__Hs3U |
| 70 | 139276 | vaccine MRSA IsdB antigen | MRSA_IsdB.fl.__FLAG__Hs3U |
| 71 | 149385 | MERS-CoV passive immunity | DPPIV.Fc__HS3U |
| 72 | 150092 | Vaccine HEV71 (polycistronic antigen containing VP1 VP2 & VP3) each separated by a furin cleavage site RKR | HEV71.VP1.2.3.VP5__HS3U |
| 73 | 144093 | vaccine Influenza HA antigen | PR8HA.Stalk__Hs3U |
| 74 | | Vaccine Klebsiella pneumoniae: cefotaxime, ceftazidime and other broad spectrum cephalosporins. | Beta-lactamase SHV-2 |
| 75 | | Vaccine PsaA SP Streptococcus pneumoniae surface adhesin A Fragment (22-309) | Pneumococcal surface adhesin A |
| 76 | | Vaccine Pseudomonas aeruginosa ampC beta-lactamase | Pseudomonas type 2 Cephalosporinase |

TABLE 28-continued

Antigen polynucleotides (RNA vaccine)

| Construct Number | Gene ID | Description | Construct |
|---|---|---|---|
| 77 | | Vaccine *Pseudomonas aeruginosa* VIM-2, a carbapenem-hydrolyzing metallo-beta-lactamase | Beta-lactamase class B VIM-2 |
| 78 | | Vaccine *Pseudomonas aeruginosa*, LCR-1 hydrolyzes methicillin. | Beta-lactamase LCR-1 |
| 79 | | Vaccine Staph aureus Toxic shock syndrome toxin-1 | Staph aureus TSST1 |
| 80 | | Vaccine Staph aureus PVL toxin | Staph aureus PVL toxin |
| 81 | | vaccine *Streptococcus pneumoniae* Pneumolysin toxoid | Pneumolysin toxoid |
| 82 | | Full length with mutations of W433F, D385N, and C428G | *Streptococcus pneumoniae* ppaC |

Additional antigens including wild type and engineered antigens are taught in Tables 29 and 30.

Pan-Flu NAVs

In one embodiment the "HA head" region of one or more influenza virus strains is removed leaving only the stem or transmembrane region. This region or multiple regions if selected, is then used as the immunogen to screen for optimal response to a viral challenge. As such broad neutralization could be achieved against multiple strains or a multi-response to one strain. The resultant vaccine would represent a pan-influenza vaccine.

Further, a pan-influenza vaccine could also be combined with any immune potentiator disclosed herein.

Polynucleotides used in the studies herein which encode certain infectious agent antigens or variants thereof may be formulated in any of the formulations described herein including LNPs and may be administered intradermally (ID) or intramuscularly (IM) or by any suitable route.

Disclosed in Table 29 are the HA regions, transmembrane and cytoplasmic regions of several influenza strains to be used in the stem vaccination generation protocol just described.

TABLE 29

| Wild type antigens encoded by NAV polynucleotides | | | | | | |
|---|---|---|---|---|---|---|
| Virus | Strain | Full length HA AA Sequence | HA1 | HA2 | TM | CY |
| H1N1 | A/PR8/34 | (SEQ ID NO: 931)<br>MKANLLVLLCALAAA<br>DADTICIGYHANNSTD<br>TVDTVLEKNVTVTHS<br>VNLLEDSHNGKLCRL<br>KGIAPLQLGKCNIAGW<br>LLGNPECDPLLPVRSW<br>SYIVETPNSENGICYPG<br>DFIDYEELREQLSSVSS<br>PERFEIFPKESSWPNHN<br>TNGVTAACSHEGKSSF<br>YRNLLWLTEKEGSYP<br>KLKNSYVNKKGKEVL<br>VLWGIHHPPNSKEQQ<br>NLYQNENAYVSVVTS<br>NYNRRFTPEIAERPKV<br>RDQAGRMNYYWTLL<br>KPGDTIIFEANGNLIAP<br>MYAFALSRGFGSGIITS<br>NASMHECNTKCQTPL<br>GAINSSLPYQNIHPVTI<br>GECPKYVRSAKLRMV<br>TGLRNNPSIQSRGLFG | (SEQ ID NO: 932)<br>MKANLLVLL<br>CALAAADAD<br>TICIGYHANN<br>STDTVDTVLE<br>KNVTVTHSV<br>NLLEDSHNG<br>KLCRLKGIAP<br>LQLGKCNIAG<br>WLLGNPECD<br>PLLPVRSWSY<br>IVETPNSENGI<br>CYPGDFIDYE<br>ELREQLSSVS<br>SFERFEIFPKE<br>SSWPNHNTN<br>GVTAACSHE<br>GKSSFYRNLL<br>WLTEKEGSY<br>PKLKNSYVN<br>KKGKEVLVL<br>WGIHHPPNSK | (SEQ ID NO: 933)<br>GLFGAIAG<br>FIEGGWTG<br>MIDGWYG<br>YHHQNEQ<br>GSGYAADQ<br>KSTQNAIN<br>GITNKVNT<br>VIEKMNIQF<br>TAVGKEFN<br>KLEKRMEN<br>LNKKVDD<br>GFLDIWTY<br>NAELLVLL<br>ENERTLDF<br>HDSNVKNL<br>YEKVKSQL<br>KNNAKEIG<br>NGCFEFYH<br>KCDNECME<br>SVRNGTYD<br>YPKYSEES | (SEQ ID NO: 934)<br>ILAI<br>YST<br>VAS<br>SLVL<br>LVSL<br>GAI | (SEQ ID NO: 935)<br>SFW<br>MCSN<br>GSLQ<br>CRICI |

TABLE 29-continued

Wild type antigens encoded by NAV polynucleotides

| Virus | Strain | Full length HA AA Sequence | HA1 | HA2 | TM | CY |
|---|---|---|---|---|---|---|
| | | AIAGFIEGGWTGMIDG WYGYHHQNEQGSGY AADQKSTQNAINGITN KVNTVIEKMNIQFTAV GKEFNKLEKRMENLN KKVDDGFLDIWTYNA ELLVLLENERTLDFHD SNVKNLYEKVKSQLK NNAKEIGNGCFEFYHK CDNECMESVRNGTYD YPKYSEESKLNREKVD GVKLESMGIYQILAIYS TVASSLVLLVSLGAISF WMCSNGSLQCRICI | EQQNLYQNE NAYVSVVTS NYNRRFTPEI AERPKVRDQ AGRMNYYW TLLKPGDTIIF EANGNLIAPM YAFALSRGFG SGIITSNASM HECNTKCQTP LGAINSSLPY QNIHPVTIGE CPKYVRSAK LRMVTGLRN NPSIQSR | KLNREKVD GVKLESMG IYQ | | |
| H1N1 | A/New Caledonia/ 20/1999 | (SEQ ID NO: 936) MKAKLLVLLCTFTAT YADTICIGYHANNSTD TVDTVLEKNVTVTHS VNLLEDSHNGKLCLL KGIAPLQLGNCSVAG WILGNPECELLISKES WSYIVETPNPENGTCY PGYFADYEELREQLSS VSSFERFEIPPKESSWP NHTVTGVSASCSHNG KSSFYRNLLWLTGKN GLYPNLSKSYVNNKE KEVLVLWGVHHPPNI GNQRALYHTENAYVS VVSSHYSRRFTPEIAK RPKVRDQEGRINYYW TLLEPGDTIIFEANGNL IAPWYAFALSRGFGSG IITSNAPMDECDAKCQ TPQGAINSSLPFQNVH PVTIGECPKYVRSAKL RMVTGLRNIPSIQSRG LFGAIAGFIEGGWTGM VDGWYGYHHQNEQG SGYAADQKSTQNAIN GITNKVNSVIEKMNTQ FTAVGKEFNKLERRM ENLNKKVDDGFLDIW TYNAELLVLLENERTL DFHDSNVKNLYEKVK SQLKNNAKEIGNGCFE FYHKCNNECMESVKN GTYDYPKYSEESKLNR EKIDGVKLESMGVYQI LAIYSTVASSLVLLVSL GAISFWMCSNGSLQCR ICI | (SEQ ID NO: 937) MKAKLLVLL CTFTATYADT ICIGYHANNS TDTVDTVLE KNVTVTHSV NLLEDSHNG KLCLLKGIAP LQLGNCSVA GWILGNPECE LLISKESWSYI VETPNPENGT CYPGYFADY EELREQLSSV SSFERFEIPPK ESSWPNHTVT GVSASCSHN GKSSFYRNLL WLTGKNGLY PNLSKSYVNN KEKEVLVLW GVHHPPNIGN QRALYHTEN AYVSVVSSH YSRRFTPEIA KRPKVRDQE GRINYYWTL LEPGDTIIFEA NGNLIAPWY AFALSRGFGS GIITSNAPMD ECDAKCQTP QGAINSSLPF QNVHPVTIGE CPKYVRSAK LRMVTGLRNI PSIQSR | (SEQ ID NO: 938) GLFGAIAG FIEGGWTG MVDGWYG YHHQNEQ GSGYAADQ KSTQNAIN GITNKVNS VIEKMNTQ FTAVGKEF NKLERRME NLNKKVD DGFLDIWT YNAELLVL LENERTLD FHDSNVKN LYEKVKSQ LKNNAKEI GNGCFEFY HKCNNEC MESVKNGT YDYPKYSE ESKLNREKI DGVKLESM GVYQ | (SEQ ID NO: 939) ILAI YST VAS SLVL LVSL GAI | (SEQ ID NO: 940) SFW MCSN GSLQ CRICI |
| H10N8 | A/JX346/ 2013 | (SEQ ID NO: 941) MYKIVVIIALLGAVKG LDKICLGHHAVANGTI VKTLTNEQEEVTNATE TVESTGINRLCMKGRK HKDLGNCHPIGMLIGT PACDLHLTGMWDTLI ERENAIAYCYPGATVN VEALRQKIMESGGINK ISTGFTYGSSINSAGTT RACMRNGGNSFYAEL KWLVSKSKGQNFPQT TNTYRNTDTAEHLIM WGIHHPSSTQEKNDLY GTQSLSISVGSSTYRN NFVPVVGARPQVNGQ SGRIDFPHWTLVQPGDN ITFSHNGGLIAPSRVSK LIGRGLGIQSDAPIDNN CESKCFWRGGSINTRL | (SEQ ID NO: 942) MYKIVVIIAL LGAVKGLDKI CLGHHAVAN GTIVKTLTNE QEEVTNATET VESTGINRLC MKGRKHKDL GNCHPIGMLI GTPACDLHLT GMWDTLIER ENAIAYCYPG ATVNVEALR QKIMESGGIN KISTGFTYGS SINSAGTTRA CMRNGGNSF YAELKWLVS KSKGQNFPQT GMWDTLIER ENAIAYCYPG ATVNVEALR QKIMESGGIN KISTGFTYGS SINSAGTTRA CMRNGGNSF YAELKWLVS KSKGQNFPQT | (SEQ ID NO: 943) RGLFGAIA GFLENGWE GMVDGWY GFRHQNAQ GTGQAAD YKSTQAAI DQITGKLN RLVEKTNT EFESIESEFS EIEHQIGNV INWTKDSIT DIWTYQAE LLVAMENQ HTIDMADS EMLNYER VRKQLRQN AEEDGKGC FEIYHACD | (SEQ ID NO: 944) WFS FGA SCFV LLA VVM GLFF F | (SEQ ID NO: 945) CLKN GNM RCTIC I |

TABLE 29-continued

Wild type antigens encoded by NAV polynucleotides

| Virus | Strain | Full length HA AA Sequence | HA1 | HA2 | TM | CY |
|---|---|---|---|---|---|---|
| | | PFQNLSPRTVGQCPKY VNRRSLMLATGMRNV PELIQGRGLFGAIAGFL ENGWEGMVDGWYGF RHQNAQGTGQAADY KSTQAAIDQITGKLNR LVEKTNTEFESIESEFS EIEHQIGNVINWTKDSI TDIWTYQAELLVAME NQHTIDMADSEMLNL YERVRKQLRQNAEED GKGCFEIYHACDDSC MESIRNNTYDHSQYRE EALLNRLNINPVTLSS GYKDIILWFSFGASCF VLLAVVMGLFFFCLK NGNMRCTICI | TNTYRNTDT AEHLIMWGIH HPSSTQEKND LYGTQSLSIS VGSSTYRNNF VPVVGARPQ VNGQSGRIDF HWTLVQPGD NITFSHNGGLI APSRVSKLIG RGLGIQSDAP IDNNCESKCF WRGGSINTRL PFQNLSPRTV GQCPKYVNR RSLMLATGM RNVPELIQG | DSCMESIR NNTYDHSQ YREEALLN RLNINPVTL SSGYKDIIL | | |
| H7N9 | A/Anhui/ 1/2013 | (SEQ ID NO: 946) MNTQILVFALIAIIPTN ADKICLGHHAVSNGT KVNTLTERGVEVVNA TETVERTNIPRICSKGK KTVDLGQCGLLGTITG PPQCDQFLEFSADLIIE RREGSDVCYPGKFVN EEALRQILRESGGIDKE AMGFTYSGIRTNGATS ACRRSGSSFYAEMKW LLSNTDNAAFPQMTKS YKNTRKSPALIVWGIH HSVSTAEQTKLYGSGN KLVTVGSSNYQQSFVP SPGARPQVNGQSGRID FHWLMLNPNDTVTFS FNGAFIAPDRASFLRG KSMGIQSGVQVDANC EGDCYHSGGTIISNLPF QNIDSRAVGKCPRYV KQRSLLLATGMKNVP EIPKGRGLFGAIAGFIE NGWEGLIDGWYGFRH QNAQGEGTAADYKST QSAIDQITGKLNRLIEK TNQQFELIDNEFNEVE KQIGNVINWTRDSITE VWSYNAELLVAMENQ HTIDLADSEMDKLYER VKRQLRENAEEDGTG CFEIFHKCDDDCMASI RNNTYDHSKYREEAM QNRIQIDPVKLSSGYK DVILWFSFGASCFILLA IVMGLVFICVKNGNM RCTICI | (SEQ ID NO: 947) MNTQILVFAL IAIIPTNADKI CLGHHAVSN GTKVNTLTER GVEVVNATE TVERTNIPRIC SKGKKTVDL GQCGLLGTIT GPPQCDQFLE FSADLIIERRE GSDVCYPGK FVNEEALRQI LRESGGIDKE AMGFTYSGIR TNGATSACR RSGSSFYAEM KWLLSNTDN AAFPQMTKS YKNTRKSPAL IVWGIHHSVS TAEQTKLYGS GNKLVTVGS SNYQQSFVPS PGARPQVNG QSGRIDFHWL MLNPNDTVT FSFNGAFIAP DRASFLRGKS MGIQSGVQV DANCEGDCY HSGGTIISNLP FQNIDSRAVG KCPRYVKQR SLLLATGMK NVPEIPKG | (SEQ ID NO: 948) RGLFGAIA GFIENGWE GLIDGWYG FRHQNAQG EGTAADYK STQSAIDQI TGKLNRLIE KTNQQFELI DNEFNEVE KQIGNVIN WTRDSITE VWSYNAEL LVAMENQ HTIDLADSE MDKLYER VKRQLREN AEEDGTGC FEIFHKCDD DCMASIRN NTYDHSKY REEAMQNR IQIDPVKLS SGYKDVIL | (SEQ ID NO: 949) WFS FGA SCFI LLAI VMG LVFI | (SEQ ID NO: 950) CVKN GNM RCTIC I |
| H7N9 | .A/Jiangsu/ 2/2013 (H242) | (SEQ ID NO: 951) MNTQILVFALIAIIPTN ADKICLGHHAVSNGT KVNTLTERGVEVVNA TETVERTNIPRICSKGK MTVDLGQCGLLGTITG PPQCDQFLEFSADLIIE RREGSDVCYPGKFVN EEALRQILRESGGIDKE AMGFTYSGIRTNGATS ACRRSGSSFYAEMKW LLSNTDNAAFPQMTKS YKNTRKSPALIVWGIH HSVSTAEQTKLYGSGN KLVTVGSSNYQQSFVP SPGARPQVNGLSGRID FHWLMLNPNDTVTFS FNGAFIAPDRASFLRG KSMGIQSGVQVDANC | (SEQ ID NO: 952) MNTQILVFAL IAIIPTNADKI CLGHHAVSN GTKVNTLTER GVEVVNATE TVERTNIPRIC SKGKMTVDL GQCGLLGTIT GPPQCDQFLE FSADLIIERRE GSDVCYPGK FVNEEALRQI LRESGGIDKE AMGFTYSGIR TNGATSACR RSGSSFYAEM KWLLSNTDN | (SEQ ID NO: 953) RGLFGAIA GFIENGWE GLIDGWYG FRHQNAQG EGTAADYK STQSAIDQI TGKLNRLIE KTNQQFELI DNEFNEVE KQIGNVIN WTRDSITE VWSYNAEL LVAMENQ HTIDLADSE MDKLYER VKRQLREN AEEDGTGC | (SEQ ID NO: 954) WFS FGA SCFI LLAI VMG LVFI | (SEQ ID NO: 955) CVKN GNM RCTIC I |

TABLE 29-continued

| Wild type antigens encoded by NAV polynucleotides | | | | |
|---|---|---|---|---|
| Virus | Strain | Full length HA AA Sequence | HA1 | HA2 | TM | CY |
| | | EGDCYHSGGTIISNLPF<br>QNIDSRAVGKCPRYV<br>KQRSLLLATGMKNVP<br>EIPKGRGLFGAIAGFIE<br>NGWEGLIDGWYGFRH<br>QNAQGEGTAADYKST<br>QSAIDQITGKLNRLIEK<br>TNQQFELIDNEFNEVE<br>KQIGNVINWTRDSITE<br>VWSYNAELLVAMENQ<br>HTIDLADSEMDKLYER<br>VKRQLRENAEEDGTG<br>CFEIFHKCDDDCMASI<br>RNNTYDHSKYReEAM<br>QNRIQIDPVKLSSGYK<br>DVILWFSFGASCFILLA<br>IVMGLVFICVKNGNM<br>RCTICI | AAFPQMTKS<br>YKNTRKSPAL<br>IVWGIHHSVS<br>TAEQTKLYGS<br>GNKLVTVGS<br>SNYQQSFVPS<br>PGARPQVNG<br>LSGRIDFHWL<br>MLNPNDTVT<br>FSFNGAFIAP<br>DRASFLRGKS<br>MGIQSGVQV<br>DANCEGDCY<br>HSGGTIISNLP<br>FQNIDSRAVG<br>KCPRYVKQR<br>SLLLATGMK<br>NVPEIPKG | FEIFHKCDD<br>DCMASIRN<br>NTYDHSKY<br>ReEAMQNR<br>IQIDPVKLS<br>SGYKDVIL | | |

In the Table, TM stands for transmembrane and CY stands for cytoplasmic.

Following the vaccine generation strategy above, engineered antigens may also be used to develop pan-flu vaccines. Such constructs are shown in Table 30.

TABLE 30

| Engineered antigens encoded by NAV polynucleotides | | | | | |
|---|---|---|

TABLE 30-continued

Engineered antigens encoded by NAV polynucleotides

| Virus | Strain | Configuration | Protein engineering | Full length Sequence | SEQ ID NO. |
|---|---|---|---|---|---|
| | | | | GRINYYWTLLEPGDTIIFEANGNLI APWYAFALSRGFGSGIITSNAPMD ECDAKCQTPQGAINSSLPFQNVHP VTIGECPKYVRSAKLRMVTGLRNI PQRETRGLFGAIAGFIEGGWTGMV DGWYGYHHQNEQGSGYAADQKS TQNAINGITNKVNSVIEKMNTQFT AVGKEFNKLERRMENLNKKVDDG FLDIWTYNAELLVLLENERTLDFH DSNVKNLYEKVKSQLKNNAKEIG NGCFEFYHKCNNECMESVKNGTY DYPKYSEESKLNREKIDSGGDIIKL LNEQVNKEMQSSNLYMSMSSWCY THSLDGAGLFLFDHAAEEYEHAK KLIIFLNENNVPVQLTSISAPEHKFE GLTQIFQKAYEHEQHISESINNIVD HAIKSKDHATFNFLQWYVAEQHE EEVLFKDILDKIELIGNENHGLYLA DQYVKGIAKSRKSGS | |
| H1N1 | PR8/34 | HA1(-) stem only HA antigen | Headless HA antigen (Stem only), transmembrane, | MKANLLVLLCALAAADADTICIG TABLE 30-continued Engineered antigens encoded by NAV polynucleotides

| Virus | Strain | Config-uration | Protein engineering | Full length Sequence | SEQ ID NO. |
|---|---|---|---|---|---|
| | | | | VNTVIEKMNIQFTAVGKEFNKLEK RMENLNKKVDDGFLDIWTYNAEL LVLLENERTLDFHDSNVKNLYEKV KSQLKNNAKEIGNGCFEFYHKCDN ECMESVRNGTYDYPKYSEESKLNR EKVDSGGDIIKLLNEQVNKEMQSS NLY MSMSSWCYTHSLDGAGLFLFDHA AEEYEHAKKLIIFLNENNVPVQLTS ISAPEHKFEGLT QIFQKAYEHEQHISESINNIVDHAIK SKDHATFNFLQWYVAEQHEEEVL FKDILDKIELI GNENHGLYLADQYVKGIAKSRKS GS | |

Example 15. Influenza Study—H1N1 Hemagglutinin (HA) Antigen

The instant study was designed in two phases, first to test the the immunogenicity of mRNA vaccines encoding HA from Influenza A/PR/8 (H1N1) in mice and second to test the efficacy of candidate influenza vaccines in mice against a lethal challenge with influenza (INFV) A/PR/8/34 (H1N1). The study design is outlined in Table 31. The NAV polynucleotide used in the study was construct 4 from Table 28.

In phase I of this study, mice were vaccinated on week 0 and 3 via intravenous (IV), intramuscular (IM), or intradermal (ID) routes. One group remained unvaccinated and one was administered inactivated PR8 antigen. Serum was collected from each mouse on weeks 1, 3 (pre-dose), and 5. Individual bleeds were tested for anti-HA activity via virus neutralization assay and HA inhibition (HAI) from all three time points and pooled samples from week 5 only were tested by Western blot using A/PR/8/34 (H1N1).

Phase II

Since the desired immune response was achieved (HAI titer >40), phase II of the study was performed. In phase II, mice were challenged with a lethal dose ($10 \times LD_{90}$; ~100 plaque-forming units; PFU) of A/PR/8/34 (H1N1) via intranasal (IN) instillation. Mice were monitored for weights, health, and survival for 14 days.

This study tested the immunogenicity of mRNA vaccines encoding HA from Influenza A/PR/8 (H1N1) in mice. The study utilized 12 groups of five BALB/c female mice. Mice were vaccinated on week 0 and 3 via intranasal (positive control), intravenous, intramuscular, or intradermal routes. One group was unvaccinated and one administered inactivated PR8 antigen via intranasal vaccination.

This study tested whether candidate ribonucleic acid vaccines and formulations could protect mice from lethal influenza A/PR/8/34 (H1N1) infection. The mice used were 6-8 week old female BALB/c mice in groups of 10. Mice were vaccinated on weeks 0 and 3 via IM, ID, or IV route. Mouse serum was tested for microneutralization and HAI. Mice were then challenged with ~1 $LD_{90}$ of influenza A/PR/8/34 (H1N1) on week 7 administered intranasally (IN). Endpoint was day 13 post infection, death, or euthanasia. Animals displaying severe illness as determined by >30% weight loss, extreme lethargy, or paralysis were euthanized. Temperature and weights were taken daily.

The LNP formulation consisted of a cationic lipid, non-cationic lipid, PEG lipid and structural lipid in the ratios 50:10:1.5:38.5. The cationic lipid was DLin-KC2-DMA (50 mol %), the non-cationic lipid was DSPC (10 mol %), the PEG lipid was PEG-DOMG (1.5 mol %) and the structural lipid was cholesterol (38.5 mol %).

Serum was collected from each mouse on weeks 1, 3 (pre-dose), and 5. Individual bleeds were tested for anti-HA activity via virus neutralization assay and HA inhibition (HAI) from all three time points (individual animals) and pooled samples from week 5 only were tested by Western blot using inactivated Influenza A/PR/8 (H1N1).

Standard Protocol for Intranasal Infection of Mice

Female 6-8 week old BALB/c mice were housed in groups of 5 mice. Mice were quarantined at the study site (Noble Life Sciences, Gaithersburg, Md.) for at least 3 days prior to the start of the study. Food and water was provided ad libitum.

The groups of mice challenged with INFV were infected via intranasal (IN) inoculation with ~10×LD90 in 100 µL of INFV in PBS under light anesthesia (Isoflurane). After the infection, mice were placed back into their cages for observation and subsequent dosing.

Microneutralization

The microneutralization protocol was the standard protocol for microneutralization of influenza as published by the World Health Organzation, 6 Dec. 2010 and outlined by the WHO Collaborating Center for Surveillance, Epidemiology and Control of Influenza, Centers for Disease Control and Prevention, Atlanta, USA, the contents of which are incorporated herein by reference in their entirety.

Serologic Diagnosis of Influenza Virus Infections by Hemagglutination Inhibition.

The standard protocol for inhibition of hemagglutination can be found in publication WHO Influenza Manual, WHO/CDS/CSR/NCS/2002.5 Rev. 1, at page 37, the contents of which are incorporated by reference in their entirety.

Briefly, the protocol is as follows.

Procedure

I. Treatment of Sera

1. Identification of Influenza Isolates by Hemagglutination.

2. Adsorb sera to remove nonspecific agglutinins as described above.

II. Standardization of RBCs

Standardize RBCs according to the procedure in art recognized procedures.

III. HA Titration of Control Antigens

Following the procedure for titration of the control antigens given above.

IV. Preparation of Standardized Antigens for HAI Test and "Back Titration"

Each control antigen must be standardized to contain 4 HA units/25 μl, 8 HA units/50 μl.

Note: Four HA units are added to the test in 25 μl because the HA unit calculations are based on a volume of 50 μl.

V. HAI Test for Serologic Diagnosis

1. Label appropriate microtiter plates.
2. Add 25 μl of PBS to wells B through H (B1-H12) of each numbered column.
3. Add 50 μl of each treated serum (1:10) to the appropriate first well (A1-A12) of the numbered column.
4. Prepare serial twofold dilutions of the treated sera by transferring 25 μl from the first well of the numbered columns 1-12 to successive wells.

Discard the final 25 μl after row H.

5. Add 25 μl of standardized antigen to all wells (A1-H12) in a set of treated sera.
6. Add 25 μl of PBS instead of antigen to the set of treated sera for serum controls (A1-H12).
7. Mix the contents of the plates by shaking on a mechanical vibrator for 10 sec or by agitating the plates manually.
8. Cover the plates and incubate at room temperature (22 to 25° C.) for 30-45 min.
9. Add 50 μl of standardized RBCs to all wells. Mix as before.
10. Cover the plates and allow the RBCs to settle at room temperature (22 to 25 C) for the appropriate time according to RBCs being used.
11. Record the HAI titers.

The positive control antigens and corresponding antisera should give consistent results when compared with previous tests. A fourfold titer increase between the acute and convalescent serum is considered diagnostically positive for that influenza type/subtype.

Western Blots

Serum from bleeds performed on vaccinated mice on week 5 was pooled and diluted 1:1000 for analysis in Western blots. Inactivated PR8 antigen was separated via SDS-PAGE and probed with the pooled sera. Positive signals were observed in groups 2-7 and 12, with the highest signals observed in groups 4-7 and 12.

500 ng per lane of inactivated PR8 antigen was separated via SDS-on 10% bis-tris gels. Protein was transferred to Polyvinylidene Difluoride (PVDF) membranes and membranes were blocked with milk and probed with a 1:1000 dilution of pooled sera from each group from week 5 bleeds. Antibody was detected with 1:3000 dilution of goat anti-mouse alkaline phosphatase (AP)

Observation of Mice

Mice were observed through 13 days post infection (14 days total, 0-13 days post infection).

Mice were weighed daily on an Ohause scale and the weights were recorded.

All animals had chips implanted at least 3 days prior to virus challenge that monitored the body temperature. The temperatures were recorded daily.

Survival and health of each mouse was evaluated once time a day.

TABLE 31

Study Design

| Group | Mouse Strain | Vaccine (n = 5 mice/group) Delivered week 0, 3 | Dosage/Route | Readouts |
|---|---|---|---|---|
| 1 | Female BALB/c, 6-8 weeks of age | N/A | N/A | Animals displaying severe illness will be euthanized. Serum samples collected on weeks 1, 3, and 5. Serum analyzed via Western blot (week 5 pooled samples), virus neutralization assay (all individuals), and HAI (all individuals). |
| 2 | | Unmodified | LNP IV, 0.4 mg/kg | |
| 3 | | N1-methyl pseudouridine/5-methyl cytosine | | |
| 4 | | Unmodified | IM, LNP 0.4 mg/kg | |
| 5 | | N1-methyl pseudouridine/5-methyl cytosine | | |
| 6 | | Unmodified | ID, LNP 0.4 mg/kg | |
| 7 | | N1-methyl pseudouridine/5-methyl cytosine | | |
| 8 | | Unmodified | ID, 80 ug w/lipoplex (Lipofectamine 2000) | |
| 9 | | N1-methyl pseudouridine/5-methyl cytosine | | |
| 10 | | Unmodified | ID, 80 ug naked mRNA | |
| 11 | | N1-methyl pseudouridine/5-methyl cytosine | | |
| 12 | | Control | IN, Inactivated PR8 virus | |

In the Table the following abbreviations apply; IM, intramuscular; ID, intradermal; IN, intranasal; IV, intravenous; LNP, lipid nanoparticle

TABLE 32

Mean HAI Titers

| Sample ID | Week 1 | Week 3 | Week 5 |
|---|---|---|---|
| Naive | 8 | 7 | 7 |
| Unmodified; LNP IV, 0.4 mg/kg | 8 | 28 | 635 |
| N1-methyl pseudouridine/5-methyl cytosine; LNP IV, 0.4 mg/kg | 25 | 139 | 2004 |
| Unmodified; LNP IM, 0.4 mg/kg | 22 | 63 | 2560 |
| N1-methyl pseudouridine/5-methyl cytosine; LNP IM, 0.4 mg/kg | 60 | 482 | 2803 |
| Unmodified; LNP ID, 0.4 mg/kg | 39 | 279 | 3796 |
| N1-methyl pseudouridine/5-methyl cytosine; LNP ID, 0.4 mg/kg | 114 | 965 | 10152 |
| Unmodified; 80 ug w/lipoplex (Lipofectamine 2000) | 7 | 17 | 197 |
| N1-methyl pseudouridine/5-methyl cytosine; 80 ug w/lipoplex (Lipofectamine 2000) | 7 | 20 | 28 |
| Unmodified; ID, 80 ug naked mRNA | 7 | 7 | 61 |
| N1-methyl pseudouridine/5-methyl cytosine; ID, 80 ug naked mRNA | 7 | 16 | 133 |
| Control PR8 Antigen | 14 | 14 | 441 |

Inhibition of Hemagglutination

Inhibition of hemagglutination (HAI) was measured in mouse sera samples on weeks 1, 3, and 5 post-vaccination. After week 1, both groups 5 and 7 displayed HAI titers over 40, at 60 and 114, respectively. On week 3, groups 3-7 displayed HAI activity over 40, with the highest being group 7 at 965. On week 5, all groups except 1 (naïve) and 9 displayed HAI activity over 40, with group 7>10,000.

It is noted that 1:40 is predictive of efficacy. An HAI titer of >40 is deemed necessary to protect from a lethal challenge of influenza.

The data showed that there was 100% rescue from lethal influenza challenge with rapid onset of protective antibody titers after 1 week and high antibody titers, i.e., 50 fold over unmodified mRNA and 20 fold over the protein vaccine. Furthermore, it was shown that for ribonucleic acid vaccines of the invention a much lower effective mRNA dose is required, i.e., ten fold less than unmodified mRNA. (FIG. 10).

Microneutralization

Two-fold dilutions of mouse sera were added to 100 TCID50/ml of virus in 96-well plates. After 24-hours of incubation, 1.5×104 Madin-Darby Canine-Kidney cells were added to each well. After a ~20 hour incubation at 37° C., virus was detected and scored with an anti-NP antibody and read at 490 nm. No neutralization activity was detected with week 1 samples (signal <50; lower limit of detection). By week 3, mice in groups 5 and 7 displayed neutralizing activity between 79 and 250 (group 5) and 250 (group 7). Neither of the other groups displayed any neutralizing activity. On week 5, groups 2-4 showed high neutralizing activity between 789 and 2493, with group 7 displaying neutralizing activity 2494 and ~25,000. The control group of mice, vaccinated with inactivated PR8, displayed neutralizing activity in 3 of 5 mice and ranged between 79 and 250. The data are shown in Tables 33-35.

TABLE 33

| Week 1 Microneutralization | | | | | |
|---|---|---|---|---|---|
| Sample ID | Mouse 1 | Mouse 2 | Mouse 3 | Mouse 4 | Mouse 5 |
| Naïve | <50* | <50 | <50 | <50 | <50 |
| Unmodified; LNP IV, 0.4 mg/kg | <50 | <50 | <50 | <50 | <50 |
| N1-methyl pseudouridine/5-methyl cytosine; LNP IV, 0.4 mg/kg | <50 | <50 | <50 | <50 | <50 |
| Unmodified; LNP IM, 0.4 mg/kg | <50 | <50 | <50 | <50 | <50 |
| N1-methyl pseudouridine/5-methyl cytosine; LNP IM, 0.4 mg/kg | <50 | <50 | <50 | <50 | <50 |
| Unmodified; LNP ID, 0.4 mg/kg | <50 | <50 | <50 | <50 | <50 |
| N1-methyl pseudouridine/5-methyl cytosine; LNP ID, 0.4 mg/kg | <50 | <50 | <50 | <50 | <50 |
| Unmodified; 80 ug w/ lipoplex (Lipofectamine 2000) | <50 | <50 | <50 | <50 | <50 |
| N1-methyl pseudouridine/5-methyl cytosine; 80 ug w/lipoplex (Lipofectamine 2000) | <50 | <50 | <50 | <50 | <50 |
| Unmodified; ID, 80 ug naked mRNA | <50 | <50 | <50 | <50 | <50 |
| N1-methyl pseudouridine/5-methyl cytosine; ID, 80 ug naked mRNA | <50 | <50 | <50 | <50 | <50 |
| Control PR8 Antigen | <50 | <50 | <50 | <50 | <50 |

*Titers of '<50' indicate titers below Limit of detection (1:50)

TABLE 34

| Week 3 Microneutralization | | | | | |
|---|---|---|---|---|---|
| Sample ID | Mouse 1 | Mouse 2 | Mouse 3 | Mouse 4 | Mouse 5 |
| Naïve | <50* | <50 | <50 | <50 | <50 |
| Unmodified; LNP IV, 0.4 mg/kg | <50 | <50 | <50 | <50 | <50 |
| N1-methyl pseudouridine/5-methyl cytosine; LNP IV, 0.4 mg/kg | <50 | <50 | <50 | <50 | <50 |
| Unmodified; LNP IM, 0.4 mg/kg | <50 | <50 | <50 | <50 | <50 |
| N1-methyl pseudouridine/5-methyl cytosine; LNP IM, 0.4 mg/kg | 79 | 79 | 79 | 250 | 250 |
| Unmodified; LNP ID, 0.4 mg/kg | <50 | <50 | <50 | <50 | <50 |
| N1-methyl pseudouridine/5-methyl cytosine; LNP ID, 0.4 mg/kg | 250 | 250 | 250 | 250 | 250 |
| Unmodified; 80 ug w/lipoplex (Lipofectamine 2000) | <50 | <50 | <50 | <50 | <50 |
| N1-methyl pseudouridine/5-methyl cytosine; 80 ug w/lipoplex (Lipofectamine 2000) | <50 | <50 | <50 | <50 | <50 |

TABLE 34-continued

Week 3 Microneutralization

| Sample ID | Mouse 1 | Mouse 2 | Mouse 3 | Mouse 4 | Mouse 5 |
|---|---|---|---|---|---|
| Unmodified; ID, 80 ug naked mRNA | <50 | <50 | <50 | <50 | <50 |
| N1-methyl pseudouridine/5-methyl cytosine; ID, 80 ug naked mRNA | <50 | <50 | <50 | <50 | <50 |
| Control PR8 Antigen | <50 | <50 | <50 | <50 | <50 |

*Titers of '<50' indicate titers below Limit of detection (1:50)

TABLE 35

Week 5 Microneutralization

| Sample ID | Mouse 1 | Mouse 2 | Mouse 3 | Mouse 4 | Mouse 5 |
|---|---|---|---|---|---|
| Naïve | <50* | <50 | <50 | <50 | <50 |
| Unmodified; LNP IV, 0.4 mg/kg | 2493 | 789 | 789 | <50 | 250 |
| N1-methyl pseudouridine/5-methyl cytosine; LNP IV, 0.4 mg/kg | 789 | 789 | 2493 | 789 | 2493 |
| Unmodified; LNP IM, 0.4 mg/kg | 789 | 789 | 2493 | 789 | 2493 |
| N1-methyl pseudouridine/5-methyl cytosine; LNP IM, 0.4 mg/kg | 789 | 2493 | 2493 | 789 | 789 |
| Unmodified; LNP ID, 0.4 mg/kg | <50 | <50 | <50 | <50 | <50 |
| N1-methyl pseudouridine/5-methyl cytosine; LNP ID, 0.4 mg/kg | 7877 | 7877 | 24892 | 2493 | 7877 |
| Unmodified; 80 ug w/ lipoplex (Lipofectamine 2000) | <50 | <50 | <50 | <50 | 79 |
| N1-methyl pseudouridine/5-methyl cytosine; 80 ug w/lipoplex (Lipofectamine 2000) | <50 | <50 | <50 | <50 | <50 |
| Unmodified; ID, 80 ug naked mRNA | <50 | 79 | <50 | <50 | <50 |
| N1-methyl pseudouridine/5-methyl cytosine; ID, 80 ug naked mRNA | <50 | <50 | <50 | <50 | <50 |
| Control PR8 Antigen | 250 | 79 | <50 | <50 | 250 |

*Titers of '<50' indicate titers below Limit of detection (1:50)

Survival

All mice were challenged with a lethal dose (10×LD90) of INFV A/PR/8/34 on week 7 post-vaccination. Mice were observed for morbidity and mortality for up to 14 days. All vaccinated mice displayed 100% survival, compared to the naïve group (group 1), which was not vaccinated. 12 groups of 5 mice were challenged via IN instillation with ~100 PFU of INFV A/PR/8/34 (H1N1). Mice were observed daily for 14 days for health, morbidity, and mortality. All animals except for unvaccinated, which died at approximately day 7, survived the 14 day study.

Weight Loss Data

Weight loss and health of mice challenged with A/PR/8/34. 12 groups of 5 mice were challenged via IN instillation with ~100 PFU of INFV A/PR/8/34 (H1N1). Mice were observed daily for 14 days for health, morbidity, and mortality.

All vaccinated mice displayed 100% survival, although some groups displayed weight loss. The unvaccinated group displayed 0% survival and died on days 6 and 7, post-infection. While differences in weight-loss were observed in challenged vaccinated mice, no conclusion can be drawn as to its significance. The group vaccinated with NAVs having N1 methylpseudouridine/5-methyl cytosine with naked mRNA displayed health scores of '2' on days 2 and 3 post-infection, but made a recovery to 'healthy' for the rest of the study. The groups vaccinated with NAVs having N1 methylpseudouridine/5-methyl cytosine ID 80 ug w/lipofecatmine 2000 (LF2000) and N1methylpseudouridine and 5-methylcytosine LNP ID both displayed health scores of '2' on days 5 and 6 post-infection which continued through the duration of the study. The LNP formulation consisted of a cationic lipid, non-cationic lipid, PEG lipid and structural lipid in the ratios 50:10:1.5:38.5. The cationic lipid was DLin-KC2-DMA (50 mol %), the non-cationic lipid was DSPC (10 mol %), the PEG lipid was PEG-DOMG (1.5 mol %) and the structural lipid was cholesterol (38.5 mol %).

All groups generally maintained weight between 90-110% of original weight with the exception of the unvaccinated group. These animals were at approximately 70% of their original weight by day 6. Health scoring was per Table 36.

TABLE 36

Health score chart

| Score | Initial | Description | Appearance | Mobility | Attitude |
|---|---|---|---|---|---|
| 1 | H | Healthy | Smooth coat, bright eyes | Active, scurrying, burrowing | Alert |
| 2 | SR | Slightly Ruffled | Slightly ruffled coat (usually only around heand and neck) | Active, scurrying, burrowing | Alert |
| 3 | R | Ruffled | Ruffled coat throughout body. A "wet" appearance | Active, scurrying, burrowing | Alert |
| 4 | S | Sick | Verr ruffled coat. Slightly closed, inset eyes | Walking, but not scurrying | Mildly lethargic |

TABLE 36-continued

Health score chart

| Score | Initial | Description | Appearance | Mobility | Attitude |
|---|---|---|---|---|---|
| 5 | VS | Very Sick (euthanized) | Very ruffled coat, closed, inset eyes | Slow to no movement; will return upright position if put on side | Extremely lethargic |
| 6 | E | Euthanize | Very ruffled coat, closed inset eyes; moribund requires human euthenasia | No movement or uncontrollable; spastic movement. Will not return to upright | Completely unaware or in noticeable distress |
| 7 | D | Deceased | — | — | — |

Example 16. MRSA Study

Antigens of MRSA which may be encoded by the ribonucleic acid vaccines include, SpA, SpAKKAA, IsdA, IsdB, SDRD, SDRE, TS ST-1, PVL, a-HL, NMD-1 and SCCmec. The study design is shown in Table 37. In these studies, construct number 27 from Table 28 was used.

A. Test for Efficacy of Modified Ribonucleic Acid Vaccines in Staph. aureus Pneumonia Challenge Model in Mice This study will test the efficacy of ribonucleic acid vaccine encoding MRSA Ag808 in BALB/c mice. The study utilizes 15 groups of 15 BALB/c female mice (225 total. Mice are vaccinated on week 0 and 3 via intradermal (ID) or intramuscular (IM) route with either an LNP Formulation comprising DLin-KC2-DMA ("KC2") or DLin-MC3-DMA ("MC3"). The KC2 LNP formulation consisted of a cationic lipid (DLin-KC2-DMA, 50 mol %), non-cationic lipid (DSPC, 10 mol %), PEG lipid (PEG-DOMG 1.5 mol %) and a structural lipid (cholesterol, 38.5 mol %). The MC3 LNP formulation consisted of a cationic lipid (DLin-MC3-DMA, 50 mol %), non-cationic lipid (DSPC, 10 mol %), PEG lipid (PEG-DOMG 1.5 mol %) and a structural lipid (cholesterol, 38.5 mol %). One group is unvaccinated and one administered a positive control antigen. Prior to challenge, mice will be bled by tail vein on weeks 1, 3 and 5 and serum samples will be retained for later analysis. The mice will be challenged with MRSA (strain Newman) at ~1×LD90 via intranasal (IN) inoculation on week 5. Mice will be monitored for morbidity using a health score assigned based on a standard scoring system, weight loss, and mortality and the endpoint is day 14 post infection, death, or euthanasia. Animals displaying severe illness as determined by >30% weight loss, extreme lethargy, or paralysis will be euthanized. Mice will be held until week 7, to perform additional work with the animals (ex. further vaccinations, bleed or infectious challenge).

B. Test for Efficacy of N1-Methylpseudouridine Modified Ribonucleic Acid Vaccines in Staphylococcus aureus Peritonitis Challenge This study tested the efficacy of a ribonucleic acid vaccine encoding MRSA Ag808 in BALB/c mice. The study utilized 15 groups of 15 BALB/c female mice (270 total. Mice were vaccinated on week 0 and 3 via intradermal (ID) or intramuscular (IM) route with either an LNP Formulation comprising DLin-KC2-DMA ("KC2") or DLin-MC3-DMA ("MC3"). The KC2 LNP formulation consisted of a cationic lipid (DLin-KC2-DMA, 50 mol %), non-cationic lipid (DSPC, 10 mol %), PEG lipid (PEG-DOMG 1.5 mol %) and a structural lipid (cholesterol, 38.5 mol %). The MC3 LNP formulation consisted of a cationic lipid (DLin-MC3-DMA, 50 mol %), non-cationic lipid (DSPC, 10 mol %), PEG lipid (PEG-DOMG 1.5 mol %) and a structural lipid (cholesterol, 38.5 mol %). One group was unvaccinated and one administered a positive control antigen. Prior to challenge, mice were bled by tail vein on weeks 1, 3 and 5 and serum samples were retained for later analysis. The mice that were challenged via intranasal instillation received a predicted challenge dose of 2e8 CFU/mouse (actual upon back-titration was 3.3e8/mouse) and the mice that were challenged via IP infection received a predicted 1e7 CFU/mouse (actual upon back-titration 6.7e6 CFU/mouse). Mice were monitored for morbidity using a health score assigned based on a standard scoring system, weight loss, and mortality and the endpoint is day 14 post infection, death, or euthanasia. Animals displaying severe illness as determined by >30% weight loss, extreme lethargy, or paralysis were euthanized.

TABLE 37

Study Design

| Group (n = 15) | Antigen | Dosage | Route | Chemistry | Formulation | Administration | Samples |
|---|---|---|---|---|---|---|---|
| 1 | N/A | N/A | N/A | N/A | NaCl | Vaccination on weeks 0 and 3 | Bled by tail vein on weeks 1, 3, and 5; retained for future analysis |
| 2 | MRSA Ag808 | 0.4 mg/kg | ID | N1methyl-pseudoruridine | LNP; KC2 | | |
| 3 | | 0.08 mg/kg | | | | | |
| 4 | | 0.016 mg/kg | | | | | |
| 5 | | 0.4 mg/kg | IM | | | | |
| 6 | | 0.08 mg/kg | | | | | |
| 7 | | 0.016 mg/kg | | | | | |
| 8 | | 0.4 mg/kg | ID | | LNP; MC3 | | |
| 9 | | 0.08 mg/kg | | | | | |
| 10 | | 0.016 mg/kg | | | | | |
| 11 | | 0.4 mg/kg | IM | | | | |
| 12 | | 0.08 mg/kg | | | | | |
| 13 | | 0.016 mg/kg | | | | | |

TABLE 37-continued

Study Design

| Group (n = 15) | Antigen | Dosage | Route | Chemistry | Formulation | Administration | Samples |
|---|---|---|---|---|---|---|---|
| 14 | Inactivated bacteria | TBD | TBD | N/A | TBD | | |
| 15 | Inactivated bacteria | TBD | TBD | N/A | TBD | | |

Mice that were vaccinated and challenged via IP route with 3% hog mucin all displayed 0% survival within 24 hours of challenge. Mice that were vaccinated and challenged via IN instillation displayed between 6 and 33% survival and median survival times between 2 and 3 days. Efficacy was not shown with either the tested RNA vaccine construct or the controls (inactivated bacteria and protein control) in either challenge model, suggesting that the model was not adequate for testing the constructs. The vehicle-vaccinated group displayed 20% survival and a median survival time of 3 days. Without being bound in theory, is is believed that the severity of the MRSA infection model precluded detection of vaccine efficacy. Other models can be tested to determine efficacy.

Example 17. Dengue Study: Dengue Virus RNA Vaccine Immunogenicity in Mice

This study provides a preliminary analysis of the immunogenicity of a nucleic acid mRNA vaccine using a dengue virus (DENV) serotype 2 antigen in BALB/c mice. The study utilizes 44 groups of 10 BALB/c female (5) and male (5) mice (440 total, 6-8 weeks of age at study initiation, see Table 38 for design summary). In this study, construct numbers used are referenced and found in Table 28.

Mice were vaccinated on weeks 0 and 3 via intramuscular (IM) or intradermal (ID) routes. One group remained unvaccinated and one was administered $10^5$ plaque-forming units (PFU) live DENV2, D2Y98P isolate via intravenous (IV) injection as a positive control. Serum was collected from each mouse on weeks 1, 3, and 5; bleeds on weeks 1 and 3 were in-life samples (tail vein or submandibular bleeds) and week 5 will be a terminal (intracardiac) bleed. Individual serum samples were stored at −80° C. until analysis by neutralization or microneutralization assay. Pooled samples from each group at the week 5 time points were tested by Western blot for reactivity with viral lysate.

TABLE 38

Detailed experimental design (treatment, readouts)

| Group | Mouse Strain | Vaccine (n = 10, female) mice/group) Delivered week 0 and 3 | Chemistry | Formulation/ Route | Dose | Readouts |
|---|---|---|---|---|---|---|
| 1 | Female BALB/c, 6-8 weeks of age | N/A | | N/A | N/A | Serum samples collected on weeks 1, 3, and 5. Serum analyzed via Western blot |
| 2 | | DEN2Y98-PrME (construct 23 from Table 28) | N1-methylpseudouridine/ 5-methyl cytosine | ID | 0.4 mg/kg in LNP | |
| 3 | | | | IM | | |
| 4 | | | | ID | 0.08 mg/kg in LNP | |
| 5 | | | | IM | | |
| 6 | | | | ID | 0.016 mg/kg in LNP | |
| 7 | | | | IM | | |
| 8 | | | N1-methylpseudouridine | ID | 0.4 mg/kg in LNP | |
| 9 | | | | IM | | |
| 10 | | | | ID | 0.08 mg/kg in LNP | |
| 11 | | | | IM | | |
| 11 | | | | ID | 0.016 mg/kg in LNP | |
| 12 | | | | IM | | |
| 13 | | DEN2Y98-PrME80 (construct 24 from Table 28) | N1-methylpseudouridine/ 5-methyl cytosine | ID | 0.4 mg/kg in LNP | |
| 14 | | | | IM | | |
| 15 | | | | ID | 0.08 mg/kg in LNP | |
| 16 | | | | IM | | |
| 17 | | | | ID | 0.016 mg/kg in LNP | |
| 18 | | | | IM | | |
| 19 | | | N1-methylpseudouridine | ID | 0.4 mg/kg in LNP | |
| 20 | | | | IM | | |
| 21 | | | | ID | 0.08 mg/kg in LNP | |
| 22 | | | | IM | | |
| 23 | | | | ID | 0.016 mg/kg in LNP | |
| 24 | | | | IM | | |
| 25 | | DEN2Y98-PrME80-DC (construct 25 from Table 28) | N1-methylpseudouridine/ 5-methyl cytosine | ID | 0.4 mg/kg in LNP | |
| 26 | | | | IM | | |
| 27 | | | | ID | 0.08 mg/kg in LNP | |
| 28 | | | | IM | | |
| 29 | | | | ID | 0.016 mg/kg in LNP | |
| 30 | | | | IM | | |

TABLE 38-continued

Detailed experimental design (treatment, readouts)

| Group | Mouse Strain | Vaccine (n = 10, female) mice/group) Delivered week 0 and 3 | Chemistry | Formulation/ Route | Dose | Readouts |
|---|---|---|---|---|---|---|
| 31 | | | N1-methylpseudouridine | ID | 0.4 mg/kg in LNP | |
| 32 | | | | IM | | |
| 33 | | | | ID | 0.08 mg/kg in LNP | |
| 34 | | | | IM | | |
| 35 | | | | ID | 0.016 mg/kg in LNP | |
| 36 | | | | IM | | |
| 37 | | DEN2-DIII-Ferritin (construct 18 from Table 28) | N1-methylpseudouridine | ID | 0.4 mg/kg in LNP | |
| 38 | | | | IM | | |
| 39 | | | | ID | 0.08 mg/kg in LNP | |
| 40 | | | | IM | | |
| 41 | | | | ID | 0.016 mg/kg in LNP | |
| 42 | | | | IM | | |
| 43 | | Control, D2Y98P live virus | — | IV | $10^5$ PFU | |

Signal was detected in groups 5, 15, 39, and 44 (live virus control) by a band that appeared between 50 and 60 kDa in the Western blot data. The data suggests that a mRNA vaccine to a single dengue viral antigen can produce antibody in preliminary studies.

Example 18. Tuberculosis Ribonucleic Acid Vaccine: Combinatorial Approach of Adjuvants and Antigens The objective of the study is to identify a multi-valent, multi-adjuvant vaccine effective in different diseases stages of tuberculosis. Initial experiment assesses 12 antigens with 8 cytokine adjuvants in three disease stage models. The antigens encoded by the polynucleotides of the invention include Ag85A (Rv3804c), Ag85B (Rv1886c), TB10.4 (Rv0288), ESAT6 (Rv3785), Rv2660L, Rv3619, Rv1813c, Rv3620c, Rv2608, Rv1196, Rv0125 and/or MT401. Target cytokine adjuvants include GM-CSF, IL-17, IFNg, IL-15, IL-2, IL-21, Anti-PD1/2 and/or Lactoferrin.

Example 19. Human Enterovirus (HEV68 and HEV71) Study

Several key antigens for use in generating vaccines have been identified. These include: (i) VP1 BC/DE loop of all three HEV68 lineages and (ii) VP1+VP2 of HEV71. The RNAV polynucleotide for use in generating vaccines from the HEV71 antigen is construct 72 from Table 28).

Example 20. MERS-CoV Study

As MERS-CoV binds cells via DPP4Fc, treatment for MERS-CoV can include an mRNA encoding DPP4-Fc with or without MERS-CoA binding site and mutant binding sites for diabetes signaling and truncated receptor binding domain of MERS-CoV Spike protein. See PLoS One. 2013; 8(12): e81587). This vaccine would act as a decoy for the virus as it will attract the MERS-CoV.

Another key vaccine for MERS-CoV is identified as an mRNA encoding MERS-CoV Spike Glucoprotein as an antigen. The protein sequence is given here (SEQ ID NO: 962).

SEQ ID NO. 962:
mihsvfllmflltptesyvdvgpdsiksacievdiqqtffdktwprpidv
skadgiiypqgrtysnitityqglfpyqgdhgdmyvysaghatgttpqkl
fvanysqdvkqfangfvvrigaaanstgtviispstsatirkiypafmlg
ssvgnfsdgkmgrffnhtivllpdgcgtllrafycileprsgnhcpagns
ytsfatyhtpatdcsdgnynrnaslnsfkeyfnlinctfmytynitedei
lewfgitqtaqgvhlfssryvdlyggnmfqfatlpvydtikyysiiphsi
rsiqsdrkawaafyvyklqpltflldfsvdgyirraidcgfndlsqlhcs
yesfdvesgvysyssfeakpsgsvveqaegvecdfspllsgtppqvynfk
rlvftncnynitkllslfsvndftcsqispaaiasncysslildyfsypl
smksdlsyssagpisqfnykqsfsnptclilatvphnittitkplkysyi
nkcsrllsddrtevpqlvnanqyspcvsivpstvwedgdyyrkqlspleg
ggwlvasgstvamteqlqmgfgitvqygtdtnsvcpklefandtkiasql
gncveyslygvsgrgvfqnctavgvrqqrfvydayqnlvgyysddgnyyc
lracvsvpvsviydketkthatlfgsvacehisstmsqysrstrsmlkrr
dstygplqtpvgcvlglynsslfvedcklplgqslcalpdtpstltprsv
rsvpgemrlasiafnhpiqvdqlnssyfklsiptnfsfgvtqeyiqttiq
kvtvdckqyvcngfqkceqllreygqfcskinqalhganlrqddsvrnlf
asvkssqsspiipgfggdfnitllepvsistgsrsarsaiedllfdkvti
adpgymqgyddcmqqgpasardlicaqyvagykvlpplmdvnmeaaytss
llgsiagvgwtaglssfaaipfaqsifyringvgitqqvlsenqkliank
fnqalgamqtgftttneafhkvqdavnnnagalsklaselsntfgaisas
igdiiqrldvleqdaqidrlingrlttlnafvaqqlvrsesaalsaqlak
dkvnecvkaqskrsgfcgqgthivsfvvnapnglyfmhvgyypsnhievv
sayglcdaanptnciapvngyfiktnntrivdewsytgssfyapepitsl -continued ntkyvapqvtyqnistnlpppllgnstgidfqdeldeffknvstsipnfg sltqinttlldltyemlslqqvvkalnesyidlkelgnytyynkwpwyiw lgfiaglvalalcvffilcctgcgtncmgklkcnrccdryeeydlephkv hvh

Example 21. H10N8 In Vitro Studies

In vitro studies on the translatability of H10 hemagglutinin mRNA were performed in HeLa cells.

Western blot analysis revealed that HA is expressed in HeLa cells following transfection with the mRNA NAV encoding the HA protein of the H10N8 strain of influenza virus.

Example 22. Influenza Study—Dosing and Formulations

A mRNA vaccine encoding the HA protein of the H1N1 strain of influenza virus was tested at various doses and in various formulations for the ability ti illicit an immune response in mice.

The efficacy of different doses and formulations were evaluated in mice. HAI titers of mice determined on Day 35 after vaccination on Day 0 and Day 21 with mRNA encoding HA of the H1N1 virus are shown in FIG. 11. Titers were highest at doses of 10 μg mRNA/mouse (400 μg mRNA/kg) with both the KC2 and MC3 formulations administered ID or IM (Table 39).

TABLE 39

Hemagglutinin inhibition titers in mice following vaccination with different doses and formulations of mRNA encoding the hemagglutinin protein of the H1N1 virus vaccine

| Group No. (n = 10 per group) | Route of Vaccination on days 0 and 21 | Vaccine | Formulation | Dose (μg/mouse) | Mean HAI titer ± SD |
|---|---|---|---|---|---|
| 1 | N/A | None | PBS | 0 | 0 |
| 2 | ID | H1N1/C1 | KC2 | 10 | 1792 ± 661 |
| 3 | | | | 2 | 1088 ± 309 |
| 4 | | | | 0.4 | 272 ± 152 |
| 5 | | | | 0.08 | 52 ± 44 |
| 6 | ID | H1N1/C0 | KC2 | 10 | 992 ± 648 |
| 7 | | | | 2 | 692 ± 743 |
| 8 | | | | 0.4 | 140 ± 78 |
| 9 | | | | 0.08 | 35 ± 31 |
| 10 | ID | H1N1/C0 | MC3 | 10 | 1600 ± 867 |
| 11 | | | | 2 | 1152 ± 588 |
| 12 | | | | 0.4 | 290 ± 254 |
| 13 | | | | 0.08 | 37 ± 25 |
| 14 | IM | H1N1/C0 | MC3 | 10 | 1664 ± 1422 |
| 15 | | | | 2 | 1056 ± 641 |
| 16 | | | | 0.4 | 800 ± 346 |
| 17 | | | | 0.08 | 180 ± 105 |
| 18 | IN | Inactivated PR8 virus | PBS | 20 μL | 96 ± 47 |
| 19 | ID | H1N1/G2/C1 | PBS | 50 | 11 ± 3 |

G0 = generation 0, i.e. canonical unmodified nucleotides; G2 = Generation 2 of the modified nucleotides; G5 = Generation 5 of the modified nucleotides (intended for clinical development).
C0 = CAP0; C1 = CAP1 (intended for clinical development)

N/A: Not applicable.

IN: intranasal: ID: intradermal; IM: intramuscular

Example 23. Influenza Study—Onset of Immunity—Survival and HA1

This study evaluated the efficacy of an mRNA vaccine encoding influenza A/PR/8 (H1N1) in female BALB/c mice following lethal challenge with influenza A/PR/8 virus. Groups of animals were vaccinated and challenged after week 1, 2, 3, or 4. Serum was collected from each mouse one day prior to challenge. Individual bleeds were tested for hemagglutination inhibition using Influenza A/PR/8 (H1N1). Control groups included unvaccinated mice and mice vaccinated with inactivated PR8 virus as a positive control. These animals were challenged in parallel with groups that were vaccinated with the mRNA vaccine. Challenge was performed with a lethal dose (100 PFU) of A/PR/8/34 (H1N1) via intranasal instillation. Animals were monitored for morbidity using a health score assigned based on a standard scoring system, weight loss and mortality. All mice receiving the mRNA vaccine showed 100% survival and minimal body weight loss (FIG. 12A-12D). At week 1 post vaccination, hemagglutination inhibition titers of mice receiving the mRNA vaccine and mice receiving the positive control vaccine were similar. However, at weeks 2, 3 and 4 post vaccination, mice receiving the mRNA vaccine showed higher mean titers compared with mice receiving the positive control vaccine (FIG. 13).

Groups of 15 female BALB/c mice (6-8 weeks of age) were vaccinated in week 0 with: mRNA encapsulated in LNP at a dose of 0.4 mg/kg by ID injection; inactivated PR8 virus given IN; or vehicle.

In weeks 1, 2, 3 and 4 after vaccination, animals were inoculated with influenza A/PR/8/34 virus under light anesthesia. The animals received 100 μL of the virus diluted in PBS to a final concentration of 1×103 PFU/mL via IN instillation.

Health assessments were performed and weights were recorded daily for 14 days (days 0-13 post infection). Survival and health was evaluated using the scoring system shown in Table 36.

All animals had chips implanted at least 3 days prior to virus challenge that monitored the body temperature. The temperatures were recorded daily. One day prior to each challenge, serum samples were collected and the serum was analyzed in an HAI assay.

Survival curves are presented in FIG. 15. The animals were monitored for survival for 14 days. Log-rank analysis was performed in GraphPad Prism v6.

Mice vaccinated with mRNA vaccine or inactivated PR8 all displayed 100% survival, while mice that were unvaccinated displayed between 0 and 40% survival (Table 40.) No significant decreases in body weight of treated mice were detected.

TABLE 40

Percent and mean survival of mice after vaccination and challenge with influenza A/PR/8/34 virus

| Group (n = 15 per group) | | % Survival | Mean Survival (Days) | Significance to Relative Vehicle Control (p values) |
|---|---|---|---|---|
| Vehicle | Week 1 | 10 | 8 | N/A |
|  | Week 2 | 40 | 10 | N/A |
|  | Week 3 | 0 | 9 | N/A |
|  | Week 4 | 6.67 | 9 | N/A |
| Inactivated PR8 virus | Week 1 | 100 | Undefined | <0.0001 |
|  | Week 2 | 100 | Undefined | 0.0004 |
|  | Week 3 | 100 | Undefined | <0.0001 |
|  | Week 4 | 100 | Undefined | <0.0001 |
| mRNA vaccine encapsulated in LNP | Week 1 | 100 | Undefined | <0.0001 |
|  | Week 2 | 100 | Undefined | 0.0004 |
|  | Week 3 | 100 | Undefined | <0.0001 |
|  | Week 4 | 100 | Undefined | <0.0001 |

Figure 13:
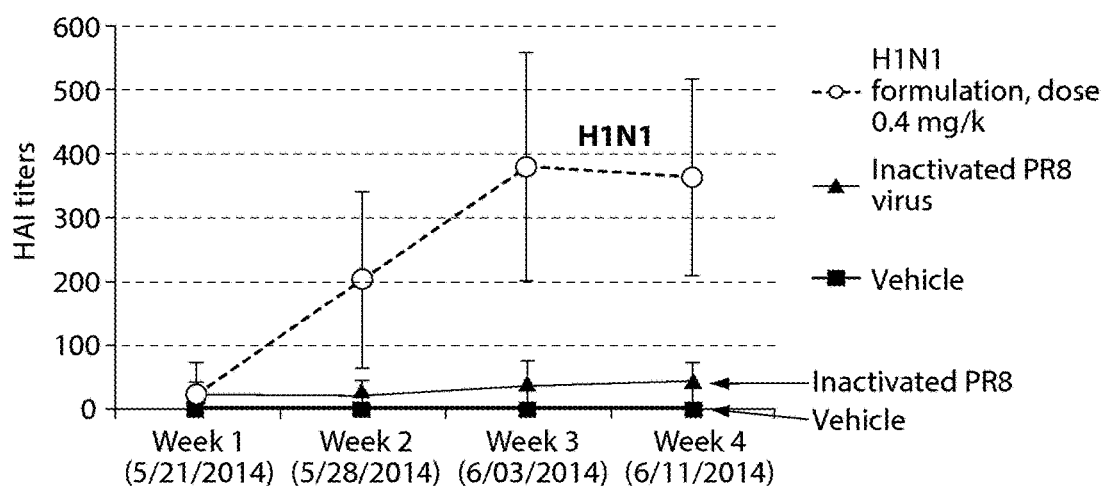
FIG. 13 shows the mean hemaglutination inhibition titers of mice after vaccination and challenge with influenza A/PR/8/34 virus

Mean HA titers are shown in FIG. 13 and Table 41.

TABLE 41

Mean hemaglutination inhibition (±SD) titers of mice after vaccination and challenge with influenza A/PR/8/34 virus

| Vaccination in week 0 | Challenge with influenza A/PR/8/34 virus | | | |
|---|---|---|---|---|
|  | Week 1 | Week 2 | Week 3 | Week 4 |
| Vehicle | 0 | 0 | 0 | 0 |
| Inactivated PR8 virus | 25 ± 47 | 19 ± 26 | 37 ± 39 | 43 ± 30 |
| mRNA vaccine | 25 ± 17 | 203 ± 138 | 379 ± 178 | 363 ± 154 |

Values are mean ± SD (standard deviation)

These data demonstrate that mice vaccinated with mRNA vaccine at a dose of 0.4 mg/kg ID or inactivated PR8 virus showed 100% survival after challenge with influenza A/PR/8/34 virus in weeks 1, 2, 3, or 4 indicating that the vaccine conveyed protection against infection with influenza A/PR/8/34 virus under the conditions of this study. HAI activity remained low in weeks 1 through 4 for animals vaccinated with inactivated PR8 virus. Mice vaccinated with mRNA showed low mean HAI titers in week 1 after challenge, but increased titers in weeks 2, 3 and 4, respectively.

Example 24. Evaluation of H1 and H7-Specific T Cell Responses in Influenza Vaccine Mice were immunized ID at week 0 and 3 with mRNA vaccine encoding the HA protein of influenza H1N1 or H7N9 virus and splenocytes were collected in week 5. T cells were stimulated for 16-18 hours with an HA peptide library (15mers of a full length protein) that reproduce the H1 or H7 sequence. Non-specific stimulation of T cells was performed using PMA+ionomycin. IFNγ ELISpot was used to identify staining for IFNγ. B cells were stimulated with either a peptide library (15mers of a full length protein) that reproduce the H1 or H7 sequence. Polyclonal B cell stimulation was performed using R848+rIL-2. B cell ELISpot was used to identify staining for antigen-specific IgG.

Figure 14A:
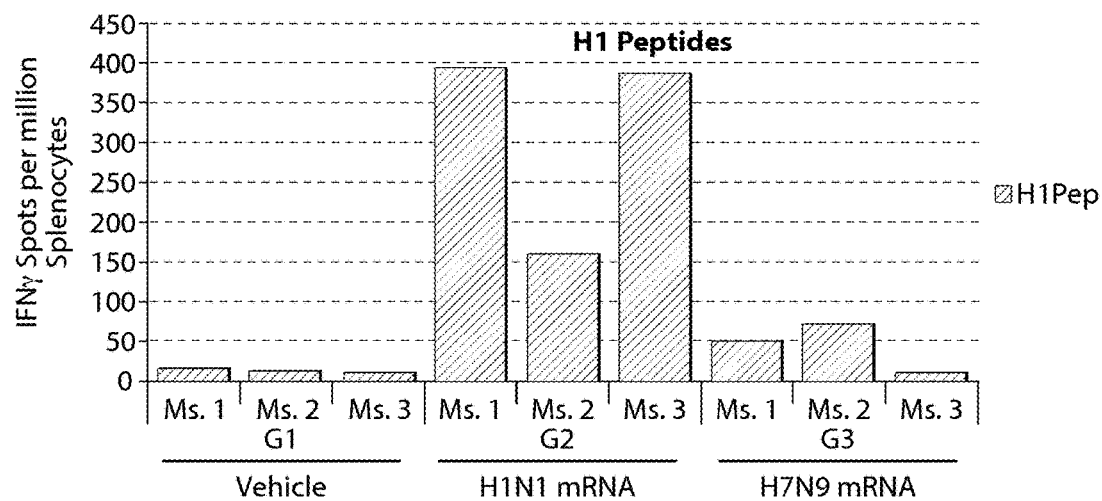
FIGS. 14A-14C shows CD4 T cell IFNγ cytokine responses.
Figure 14B:
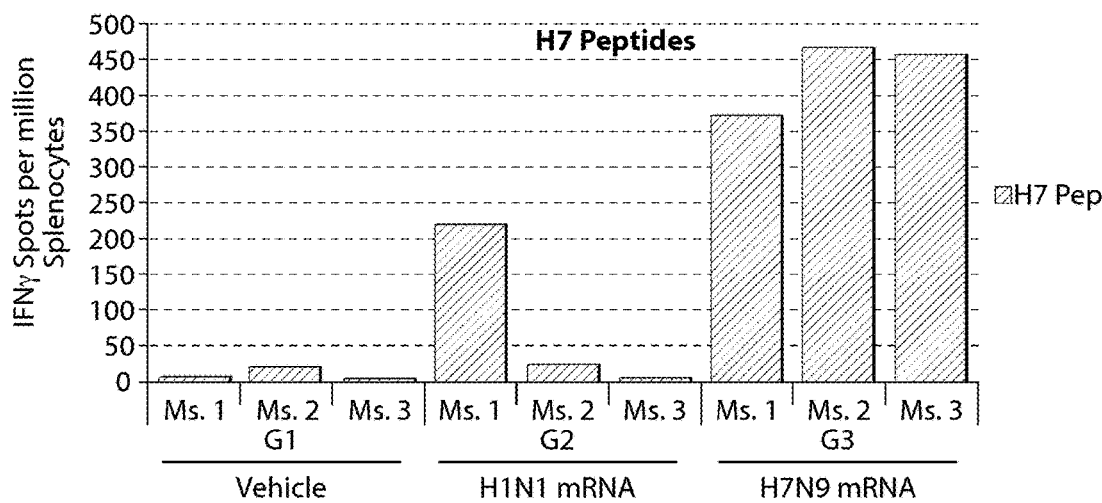
Figure 14C:
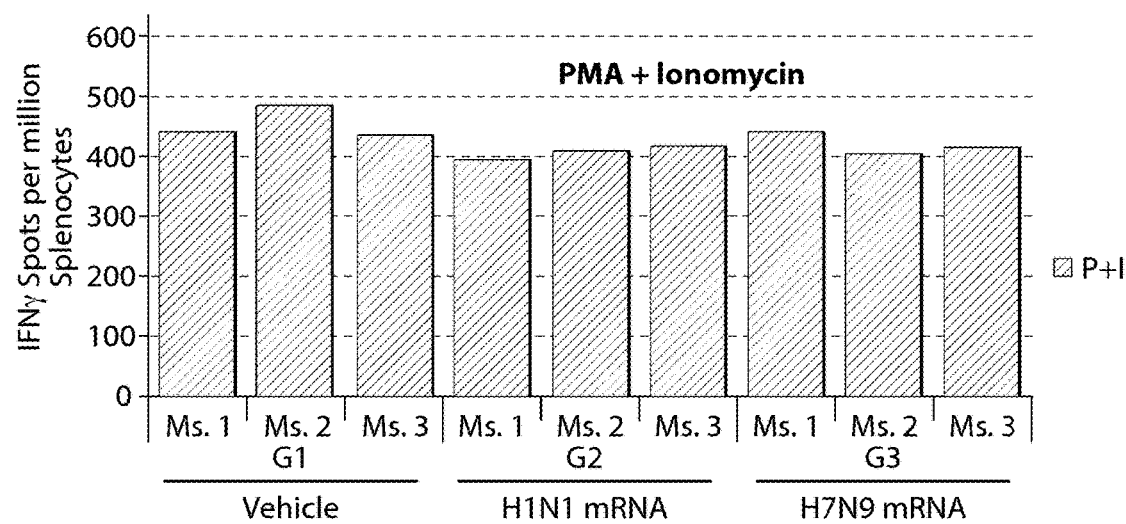
Figure 15A:
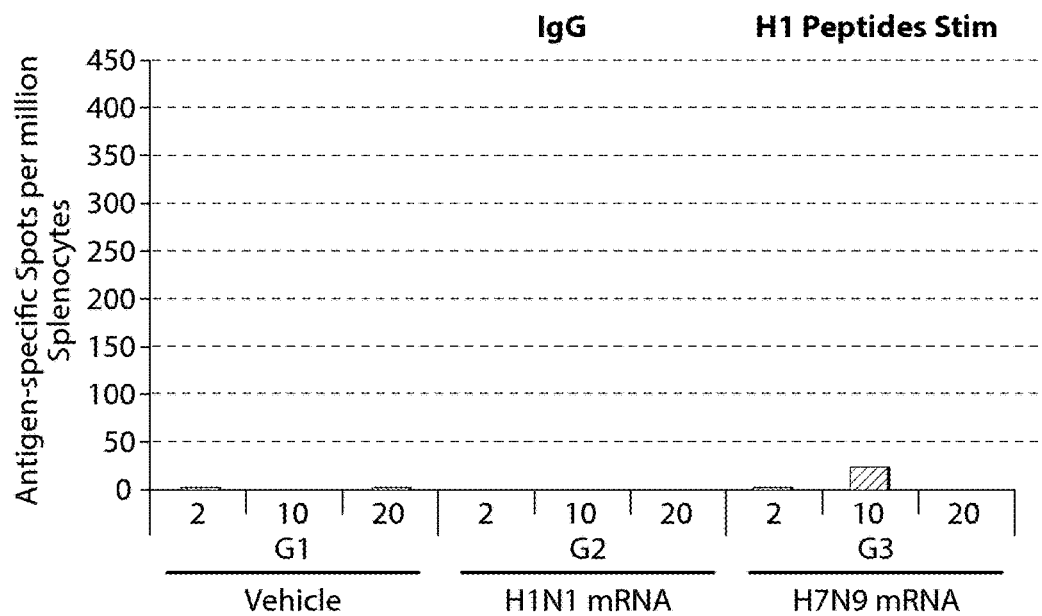
FIGS. 15A-15D shows IgG production following H1 and H7 protein/peptide stimulation.
Figure 15B:
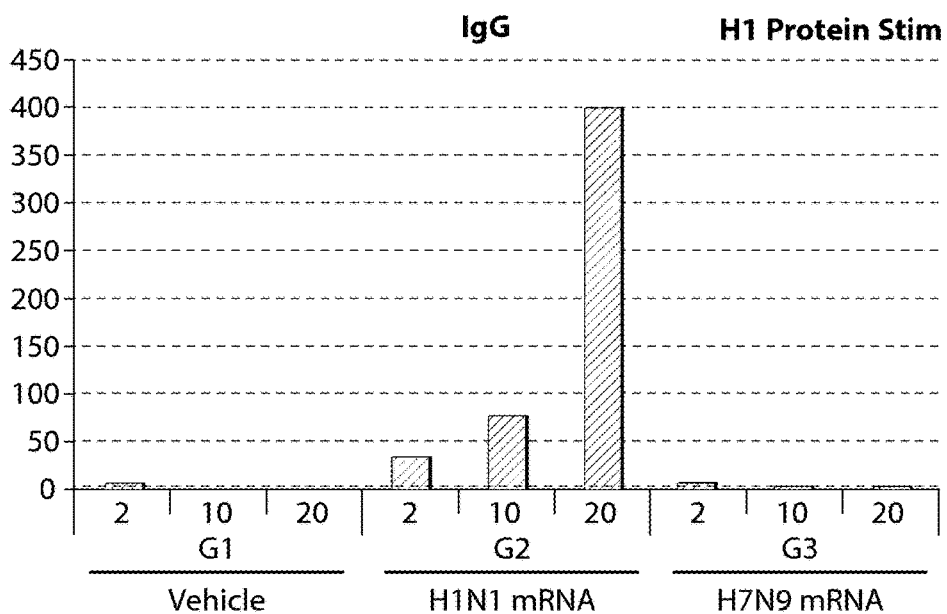
Figure 15C:
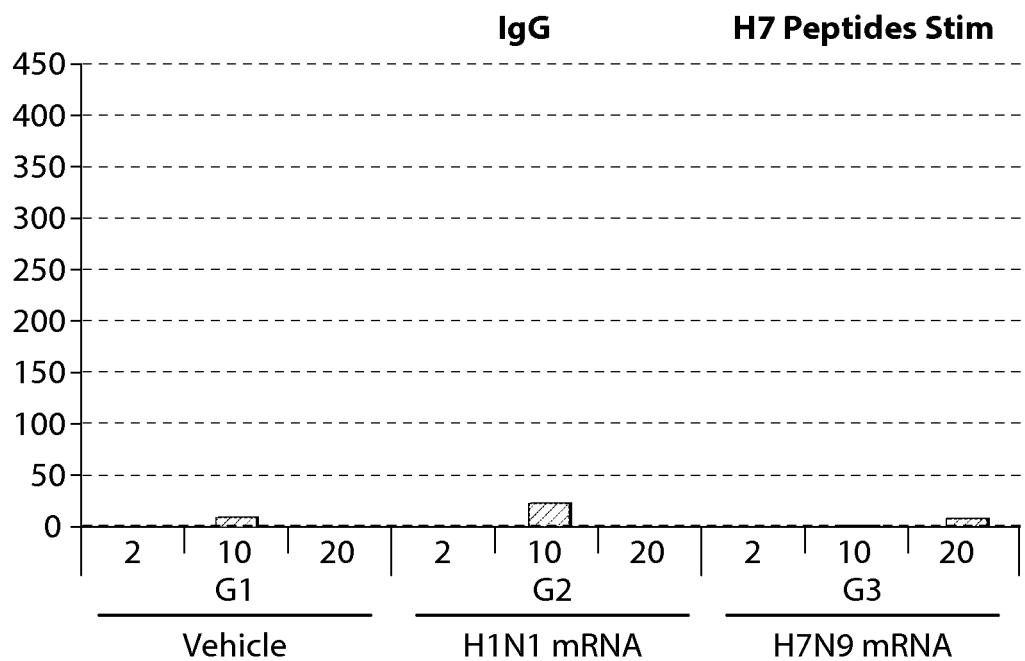
Figure 15D:
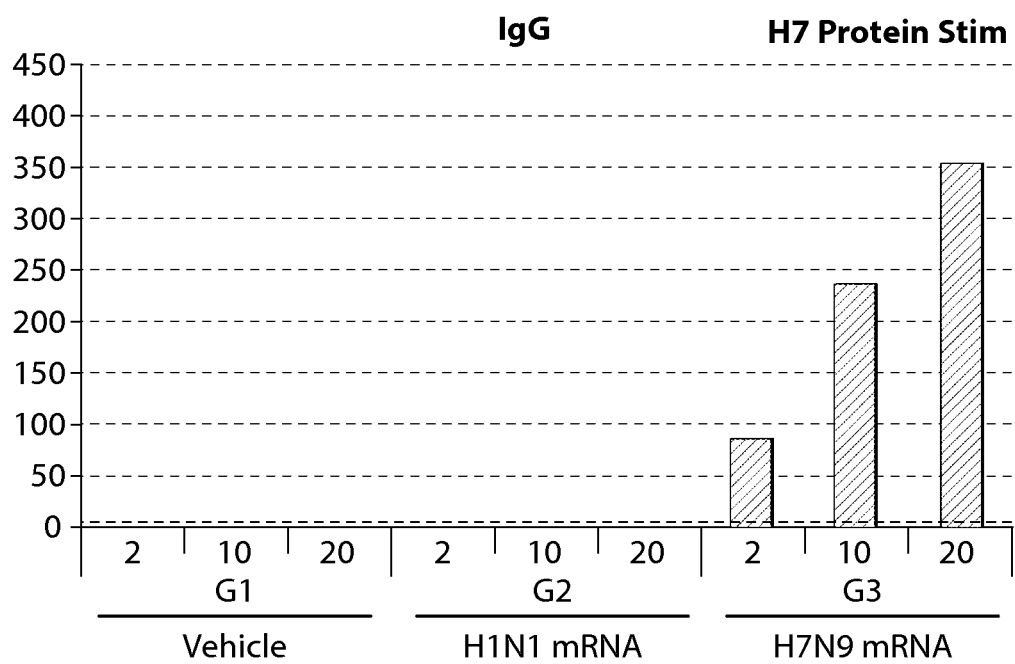

IFNγ ELISpot results demonstrated increased IFNγ secretion by T cells after stimulation with H1 or H7 peptides (FIGS. 14A and 14B). No increased IFNγ secretion was observed in T cells stimulated with PMA+ionomycin (FIG. 14C). The results demonstrated that T cell responses are antigenspecific.

B cell ELISpot results demonstrated IgG secretion upon stimulation of B cells with full antigen, but not with H1/H7 peptides (FIGS. 15A-15D). The lack of stimulation with the peptide library was to be expected because an IgG response is stimulated via MHCII antigens, which tend to be longer than MHCI antigen needed for stimulation of a T cell response.

Example 25. Evaluation of H1, H7, and MO-Specific T and B Cell Response Against Influenza Vaccines in Mouse Splenocytes Influenza-specific T and B cell responses were evaluated following administration of mRNA vaccines (NAVs) encoding the H1, H10, and H7 hemagglutinin proteins. Briefly, 36 groups of 5 female 6-8 week old BALB/c mice were vaccinated with various doses via the intradermal route (ID) on day 0. Seven-week post vaccination, animals were sacrificed and spleens were harvested. The splenocytes were assessed by IFNγ ELISpot; Intracellular Cytokine Staining (ICS) for CD3, CD4, CD8, CD45, CCR7, CD44, CD25, IL-2 IFNγ, and TNFα markers; and by B-cell ELISpot.

IFNγ ELISpot Analyses

Splenocytes from groups of mice that had been administered H10N8/N1-methyl pseudouridine/C0 were assessed for H1, H7 and H10-specific IFNγ production by IFNγ ELISpot. Naïve mice did not yield measurable IFNγ cytokine response, whereas H10 peptide-specific IFNγ ELISpot responses were detected in mice vaccinated intradermally with H10N8/N1-methyl pseudouridine/C0. The magnitude of these responses was found to be dependent on the dose of the vaccine administered. Peptide-stimulated splenocytes did not yield detectable H1- or H7-specific IFNγ ELISpot responses. All groups produced IFNγ ELISpot responses following stimulation with PMA+ionomycin (positive control).

H1 peptide-specific IFNγ ELISpot responses were detected from splenocytes isolated from mice that had been administered H1N1/G2/C1, H1N1/G2/C0 (MC3 formulation), or H1N1/G2/C0 (KC2 formulation) intradermally, as well as from splenocytes from mice that had been administered H1N1/G2/C0 (MC3 formulation) intramuscularly.

H7 peptide-specific IFNγ ELISpot responses were detected from splenocytes isolated from mice that had been administered H7N9/G2/C0 either intradermally or intramuscularly.

Splenocytes from control mice that had received H1N1/G2/C1/PBS showed no response to peptide stimulation.

B Cell ELISpot Analyses

Briefly, H1-specific IgG and IgM responses were detected in several groups of mice vaccinated with different H1 vaccine formulations. H7- and H10-specific IgG and IgM responses were also elicited in the H7N9/N1-methyl pseudouridine/C0- and H10N8/N1-methyl pseudouridine/C0-vaccinated mice, respectively.

Intracellular Cytokine Staining Results

Intracellular Cytokine Staining and flow cytometric analysis indicated that H1-specific Th1 (IFNγ, TNFα, IL-2) cytokine responses were induced at both 16-18 hrs and 48 hrs in CD4+ T cells and CD8+ T cells following stimulation of splenocytes from H1-vaccinated mice with corresponding peptide or protein.

Additionally, H7- and H-10 peptide and protein-specific Th1 (IFNγ, TNFα, IL-2) responses were also detected in CD4+ and CD8+ T cells. H7-specific responses were noted in groups vaccinated with H7 vaccine formulations, and H10-specific responses were seen in groups vaccinated with H10 vaccine formulations.

Example 26. Evaluation of H7- and MO-Specific T and B Cell Response Against Influenza Vaccines in Mouse Splenocytes—Time Course Influenza-specific T and B cell responses were evaluated following administration of mRNA vaccines (NAVs) encoding the H10 and H7 hemagglutinin proteins. Briefly, 27 groups of 5 female 6-8 week old BALB/c mice (135 mice total) were vaccinated with various doses via the intradermal route (ID) on day 0 shown in Table 42. On days 7, 21, and 84 groups of 5 animals were sacrificed and blood samples and spleens were harvested.

The mouse spleens were analyzed using IFNγ ELISPOT, IgG ELISPOT (for B cell responses), and Intracellular Cytokine Staining (ICS). Serum samples were analyzed for inhibition of hemagglutin (HAI) by first treating with Receptor Destroying Enzyme (RDE) to inactivate non-specific inhibitors of hemagglutination (false positives) present in the sera. Next, RDE-treated sera were adsorbed using red blood cells (RBCs) to remove non-specific agglutinin (false negatives). Serially-diluted treated sera (2-fold dilutions) were pre-incubated with a standardized quantity of recombinant influenza antigen before RBCs were added to the mixture. Inhibition of hemagglutination indicates the presence of HA-specific antibodies. Pooled anti-H10 mouse serum was used as a positive control and showed HAI titers within range of previously-observed data.

After receiving a single dose of the mRNA NAVs on day 0, HAI titers were not detected at day 7 (Table 42) but were detected at day 21 (Table 43) and continued to increase through day 84 (Table 44). Day 84 titers were 2-fold to 15-fold higher than those from day 21 (FIGS. 15 and 16).

Figure 17:
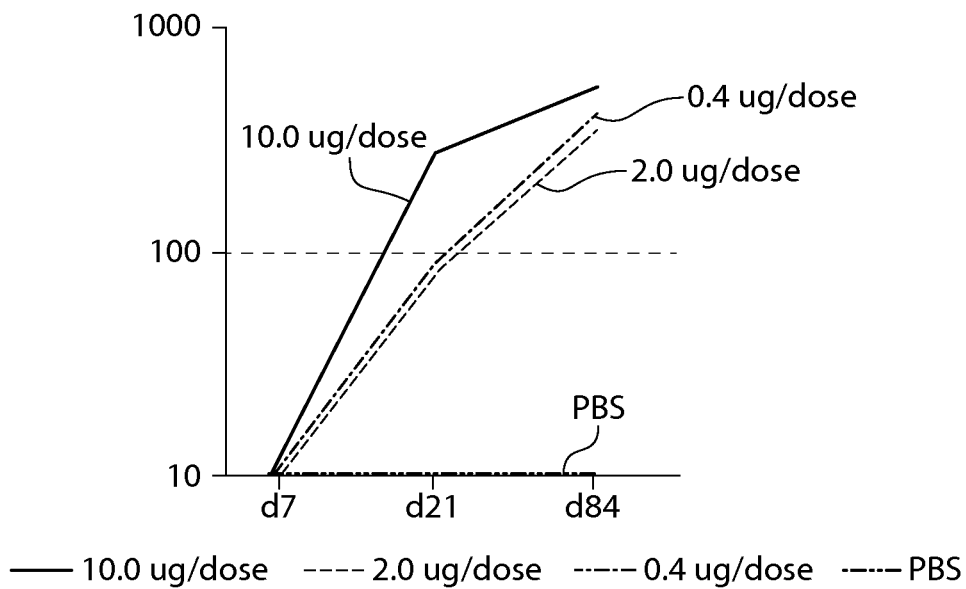
FIG. 17 is a graph showing hemagglutinin inhibition titers (HA1) against H10 following administration of the H10N8/N1-methyl pseudouridine/C1 formulation MC3 vaccine at the indicated dosages.
Figure 18:
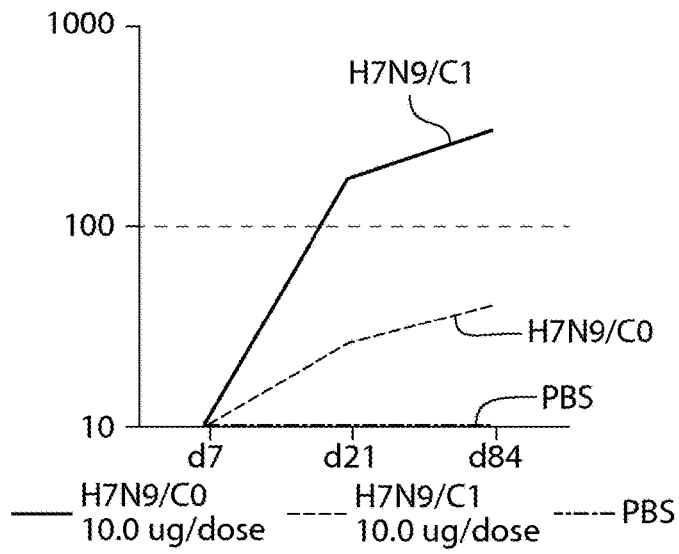
FIG. 18 is a graph comparing hemagglutinin inhibition titers (HA1) against H7 following administration of 10 μg/dose of the H7N9/C0 formulation compared to the H7N9/C1 formulation.

Administration of the H10N8/N1-methyl pseudouridine/C1 formulation MC3 resulted in higher HAI titers as compared to the HAI titers induced by the H10N8/N1-methyl pseudouridine/CO formulation MC3 (FIG. 17). The MC3 LNP formulation consisted of a cationic lipid (DLin-MC3-DMA, 50 mol %), non-cationic lipid (DSPC, 10 mol %), PEG lipid (PEG-DOMG 1.5 mol %) and a structural lipid (cholesterol, 38.5 mol %).

Figure 16:
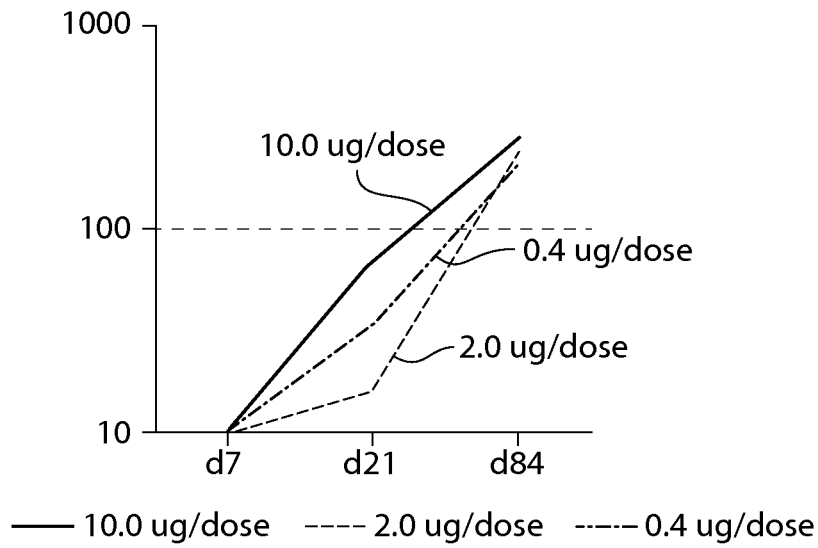
FIG. 16 is a graph showing hemagglutinin inhibition titers (HA1) against H10 following administration of the H10N8/N1-methyl pseudouridine/C0 formulation MC3 vaccine at the indicated dosages.

Administration of the H10N8/N1-methyl pseudouridine/C1 formulation MC3 at 10 µg/dose achieved the highest HAI titers, whereas the HAI titers following administration of the 2.0 µg/dose and 0.4 µg/dose are similar to each other (FIG. 16).

TABLE 42

HAI Titers against H10 and H7 at Day 7

| mRNA vaccine once at day 0 via ID injection | Dose per mouse (µg) | Group (N = 5) | HAI titers of mouse sera Day 0 (Nov. 10, 2014) = vaccination day 0 Day 7 (Nov. 17, 2014) = terminal bleeds groups 1-9 | | | | | | | | |
|---|---|---|---|---|---|---|---|---|---|---|---|
| | | | M1 | M2 | M3 | M4 | M5 | | Mean | Stdev | |
| H10N8/N1-methyl pseudouridine/C1, formulation MC3 | 10 | 1 | <10 | <10 | <10 | <10 | <10 | < | 10 | N/A | HAI titers against H10 protein |
| | 2 | 2 | <10 | <10 | <10 | <10 | <10 | < | 10 | N/A | |
| | 0.4 | 3 | <10 | <10 | <10 | <10 | <10 | < | 10 | N/A | |
| H10N8/N1-methyl pseudouridine/C0, formulation MC3 | 10 | 4 | <10 | <10 | <10 | <10 | <10 | < | 10 | N/A | |
| | 2 | 5 | <10 | <10 | <10 | <10 | <10 | < | 10 | N/A | |
| | 0.4 | 6 | <10 | <10 | <10 | <10 | <10 | < | 10 | N/A | |
| PBS | 0 | 7 | <10 | <10 | <10 | <10 | <10 | < | 10 | N/A | |
| PBS | 0 | 7 | <10 | <10 | <10 | <10 | <10 | < | 10 | N/A | HAI titers against H7 protein |
| H7N9/C0 | 10 | 8 | <10 | <10 | <10 | <10 | <10 | < | 10 | N/A | |
| H7N9/C1 | 10 | 9 | <10 | <10 | <10 | <10 | <10 | < | 10 | N/A | |

TABLE 43

HAI Titers against H10 and H7 at Day 21

| mRNAna vaccine once at day 0 via ID injection | Dose per mouse (µg) | Group (N = 5) | HAI titers of mouse sera Day 0 (Nov. 10, 2014) = vaccination day 0 Day 21 (Dec. 1, 2014) = terminal bleeds group 10-18 | | | | | | | | |
|---|---|---|---|---|---|---|---|---|---|---|---|
| | | | M1 | M2 | M3 | M4 | M5 | | Mean | Stdev | |
| H10N8/N1-methyl pseudouridine/C1, formulation MC3 | 10 | 10 | 160 | 320 | 640 | 80 | 160 | | 272 | 223 | HAI titers against H10 protein |
| | 2 | 11 | 40 | 80 | 40 | 80 | 160 | | 80 | 49 | |
| | 0.4 | 12 | 80 | 160 | 40 | 80 | 80 | | 88 | 44 | |
| H10N8/N1-methyl pseudouridine/C0, formulation MC3 | 10 | 13 | 160 | 40 | 80 | 20 | 40 | | 68 | 56 | |
| | 2 | 14 | 20 | 20 | 10 | 10 | 20 | | 16 | 5 | |
| | 0.4 | 15 | 20 | 10 | 40 | 20 | 80 | | 34 | 28 | |
| PBS | 0 | 16 | <10 | <10 | <10 | <10 | <10 | < | 10 | N/A | |

TABLE 43-continued

HAI Titers against H10 and H7 at Day 21

| mRNAna vaccine once at day 0 via ID injection | Dose per mouse (μg) | Group (N = 5) | HAI titers of mouse sera Day 0 (Nov. 10, 2014) = vaccination day 0 Day 21 (Dec. 1, 2014) = terminal bleeds group 10-18 | | | | | | | |
|---|---|---|---|---|---|---|---|---|---|---|
| | | | M1 | M2 | M3 | M4 | M5 | Mean | Stdev | |
| PBS | 0 | 16 | <10 | <10 | <10 | <10 | <10 | < 10 | 0 | HAI titers |
| H7N9/C0 | 10 | 17 | 40 | 10 | 10 | 20 | 20 | 26 | 13 | against H7 |
| H7N9C1 | 10 | 18 | 160 | 160 | 160 | 320 | 80 | 176 | 88 | protein |

TABLE 44

HAI Titers against H10 and H7 at Day 84

| mRNA vaccine once at day 0 via ID injection | Dose per mouse (μg) | Group (N = 5) | HAI titers of mouse sera Day 0 (Nov. 10, 2014) = vaccination day 0 Day 84 (Feb. 2, 2015) = terminal bleeds groups 19-27 | | | | | | | |
|---|---|---|---|---|---|---|---|---|---|---|
| | | | M1 | M2 | M3 | M4 | M5 | Mean | Stdev | |
| H10N8/N1-methyl | 10 | 19 | 160 | 320 | 320 | 1280 | 640 | 544 | 447 | HAI titers |
| pseudouridine/C1, | 2 | 20 | 320 | 320 | 640 | 160 | 320 | 352 | 175 | against H10 |
| formulation MC3 | 0.4 | 21 | 640 | 320 | 160 | 320 | 640 | 416 | 215 | protein |
| H10N8/N1-methyl | 10 | 22 | 160 | 320 | 320 | 320 | 320 | 288 | 72 | |
| pseudouridine/C0, | 2 | 23 | 320 | 320 | 160 | 80 | 320 | 240 | 113 | |
| formulation MC3 | 0.4 | 24 | 40 | 320 | 320 | 320 | 80 | 216 | 143 | |
| PBS | 0 | 25 | <10 | <10 | <10 | <10 | <10 | < 10 | N/A | |
| PBS | 0 | 25 | <10 | <10 | <10 | <10 | <10 | < 10 | N/A | HAI titers |
| H7N9/C0 | 10 | 26 | 20 | 40 | 80 | 20 | <10 | ≤ 40 | 28 | against H7 |
| H7N9/C1 | 10 | 27 | 640 | 320 | 320 | 160 | 80 | 304 | 215 | protein |

Figure 19:
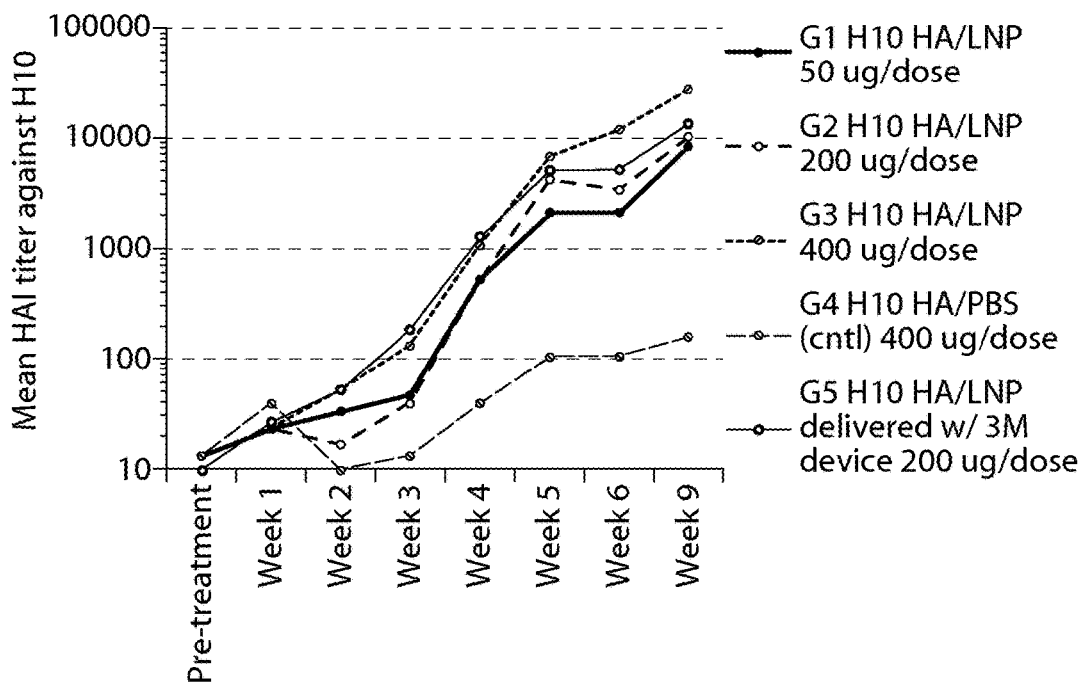
FIG. 19 is a graph of the mean hemagglutinin inhibition titers (HA1) in serum samples from cynomolgus monkey at various time points prior to and after administration of the indicated formulations and dosages.

Example 27. Anti-H10 Hemagglutinin Analysis in Non-Human Primates—Dose Range Study Groups of cynomoglus monkeys were vaccinated with various doses of NAV encoding H10 HA/LNP formulations (50 μg/dose, 200 μg/dose, 400 μg/dose), NAV encoding H10 HA/LNP delivered with 3M device, or control NAV encoding H10 HA/PBS. Serum samples were taken from the monkeys weekly and evaluated for inhibition of hemagglutinin (Table 45, FIG. 19).

TABLE 45

HAI titers against H10 protein

| | HAI titers against H10 protein (A/Jiangxi-Donghu/346/2013) | | | | | | | | |
|---|---|---|---|---|---|---|---|---|---|
| | Cynomolgus monkey ID | Pre-treatment | Week 1 | Week 2 | Week 3 | Week 4 | Week 5 | Week 6 | Week 9 |
| Group 1 | 1001 | 10 | 40 | 20 | 20 | 320 | 1280 | 1280 | 5120 |
| (50 μg) | 1002 | 20 | 20 | 40 | 40 | 640 | 2560 | 2560 | 10240 |
| | 1003 | <10 | <10 | 40 | 80 | 640 | 2560 | 2560 | 10240 |
| | Mean | <13 | <23 | 33 | 47 | 533 | 2133 | 2133 | 8533 |
| Group 2 | 2001 | <10 | <10 | 10 | 40 | 640 | 5120 | 2560 | 10240 |
| (200 μg) | 2002 | 20 | 20 | 20 | 40 | 640 | 2560 | 2560 | 10240 |
| | 2003 | <10 | 40 | 20 | 40 | 320 | 5120 | 5120 | 10240 |
| | Mean | <13 | <23 | 17 | 40 | 533 | 4267 | 3413 | 10240 |
| Group 3 | 3001 | 20 | <10 | 40 | 80 | 1280 | 5120 | 10240 | 20480 |
| (400 μg) | 3002 | <10 | 40 | 40 | 160 | 640 | 5120 | 5120 | 20480 |
| | 3003 | <10 | 20 | 80 | 160 | 1280 | 10240 | 20480 | 40960 |
| | Mean | <13 | <23 | 53 | 133 | 1067 | 6827 | 11947 | 27307 |
| Group 4 | 4001 | <10 | 40 | <10 | 20 | 40 | 80 | 80 | 160 |
| (vaccine device) | 4002 | <10 | 40 | <10 | <10 | 40 | 160 | 160 | 160 |
| | 4003 | 20 | 40 | <10 | 10 | 40 | 80 | 80 | 160 |
| | Mean | <13 | 40 | <10 | <13 | 40 | 107 | 107 | 160 |

TABLE 45-continued

HAI titers against H10 protein

HAI titers against H10 protein (A/Jiangxi-Donghu/346/2013)

| | Cynomolgus monkey ID | Pre-treatment | Week 1 | Week 2 | Week 3 | Week 4 | Week 5 | Week 6 | Week 9 |
|---|---|---|---|---|---|---|---|---|---|
| Group 5 (PBS) | 5001 | <10 | 20 | 80 | 320 | 1280 | 5120 | 5120 | 10240 |
| | 5002 | <10 | 20 | 40 | 160 | 1280 | 5120 | 5120 | 10240 |
| | 5003 | <10 | 40 | 40 | 80 | 1280 | 5120 | 5120 | 20480 |
| | Mean | <10 | 27 | 53 | 187 | 1280 | 5120 | 5120 | 13653 |

Assay Positive Control: Anti-H10 Pool of 9 mouse sera M1, M2, M3, of Group 1, N1-methyl pseudouridine (m$^1\Psi$) and 5-methyl cytidine, Group 3 of study day 14 HAI titer = 160

Assay Positive Control: Anti H-10 Pool of 9 mouse sera M1, M2, M3 of Group 1, N1-methyl pseudouridine (m$^1\Psi$) and 5-methyl cytidine, Group 3 of study day 14 HAI titer = 80

Example 28. Determination of Time to Onset of Immunity Using an H7N9 Vaccine in a Ferret Model The time to onset of immunity (as measured by antibody titers and reduction in viral titers following challenge) of an influenza A/Anhui/1/2013 (H7N9) vaccine was evaluated in a ferrets model of influenza infection. Briefly, twenty groups of 8 ferrets each were vaccinated on day 0 with the H7N9 mRNA NAV vaccine at a dose of 10 μg, 50 μg, or 200 μg, a vH7N9 vaccine lacking the 14 kDa cap at a dose of 200 μg, or PBS control via the intradermal route. Five of the 20 groups received a second vaccination (a booster) to determine if a second dose increased protection. The animals were then exposed to influenza A/Anhui/1/2013 (H7N9) virus via the intranasal route. The study design is shown in Table 45:

TABLE 45

| Study Design | | | | | |
|---|---|---|---|---|---|
| Group No. | Vaccine Dose | Day of Vaccination | No. of Animals | Day of Challenge | Day of Blood Draws |
| 1 | H7N9/N1-methyl pseudouridine/ C1/MC3, 200 μg | 0 | 8 | 7 | 0, 7 |
| 2 | H7N9/N1-methyl pseudouridine/ C1/MC3, 50 μg | 0 | 8 | 7 | 0, 7 |
| 3 | H7N9/N1-methyl pseudouridine/ C1/MC3, 10 μg | 0 | 8 | 7 | 0, 7 |
| 4 | PBS | 0 | 8 | 7 | 0, 7 |
| 5 | H7N9/MC3 (−14 kDa Cap) 200 μg | 0 | 8 | 7 | 0, 7 |
| 6 | H7N9/N1-methyl pseudouridine/ C1/MC3, 200 μg | 0 | 8 | 21 | 0, 21 |
| 7 | H7N9/N1-methyl pseudouridine/ C1/MC3, 50 μg | 0 | 8 | 21 | 0, 21 |
| 8 | H7N9/N1-methyl pseudouridine/ C1/MC3, 10 μg | 0 | 8 | 21 | 0, 21 |
| 9 | PBS | 0 | 8 | 21 | 0, 21 |
| 10 | H7N9/MC3 (−14 kDa Cap) 200 μg | 0 | 8 | 21 | 0, 21 |
| 11 | H7N9/N1-methyl pseudouridine/ C1/MC3, 200 μg | 0 | 8 | 49 | 0, 49 |
| 12 | H7N9/N1-methyl pseudouridine/ C1/MC3, 50 μg | 0 | 8 | 49 | 0, 49 |
| 13 | H7N9/N1-methyl pseudouridine/ C1/MC3, 10 μg | 0 | 8 | 49 | 0, 49 |
| 14 | PBS | 0 | 8 | 49 | 0, 49 |
| 15 | H7N9/MC3 (−14 kDa Cap) 200 μg | 0 | 8 | 49 | 0, 49 |
| 16 | H7N9/N1-methyl pseudouridine/ C1/MC3, 200 μg | 4, 25 | 8 | 53 | 4, 25, 53 |
| 17 | H7N9/N1-methyl pseudouridine/ C1/MC3, 50 μg | 4, 25 | 8 | 53 | 4, 25, 53 |
| 18 | H7N9/N1-methyl pseudouridine/ C1/MC3, 10 μg | 4, 25 | 8 | 53 | 4, 25, 53 |
| 19 | PBS | 4, 25 | 8 | 53 | 4, 25, 53 |
| 20 | H7N9/MC3 (−14 kDa Cap) 200 μg | 4, 25 | 8 | 53 | 4, 25, 53 |

Because H7N9 does not induce a lethal disease in ferrets, the primary endpoint was viral burden in tissues (primarily lung) 3 days post-challenge, as determined by TCID50 (50% tissue culture infective dose). In addition to viral titers, blood was collected prior to vaccination and immediately prior to challenge to determine influenza-specific antibody titers, as determined by hemagglutination inhibition (HAI) and microneutralization (MN) assays.

Figure 20:
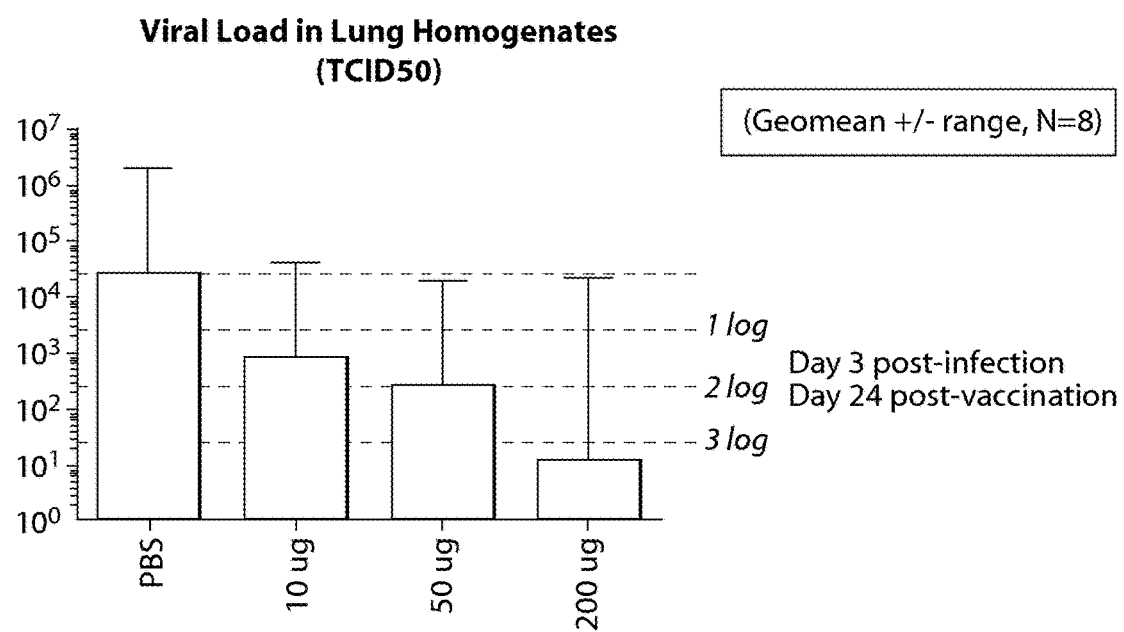
FIG. 20 is a graph showing the H7N9 viral load in ferrets challenged at day 21 after receiving a single immunization.
Figure 21A:
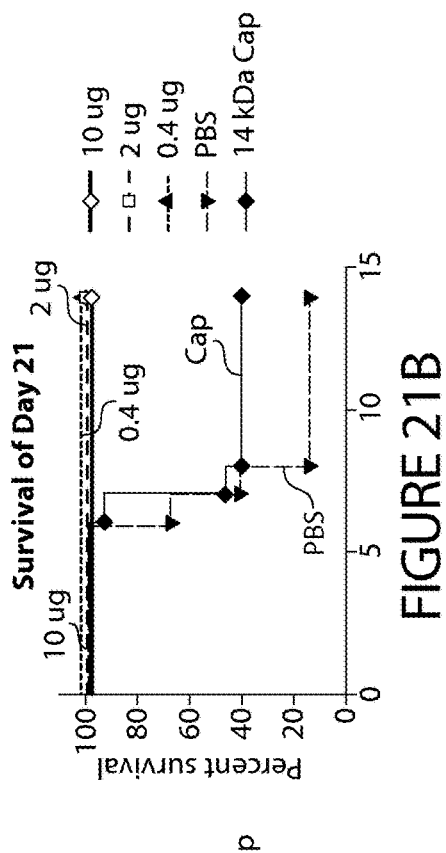
FIGS. 21A-21D present mouse survival and HA1 titers in mice challenged with a lethal dose following administration of a single dose of mRNA NAV encoding H7N9.
Figure 21B:
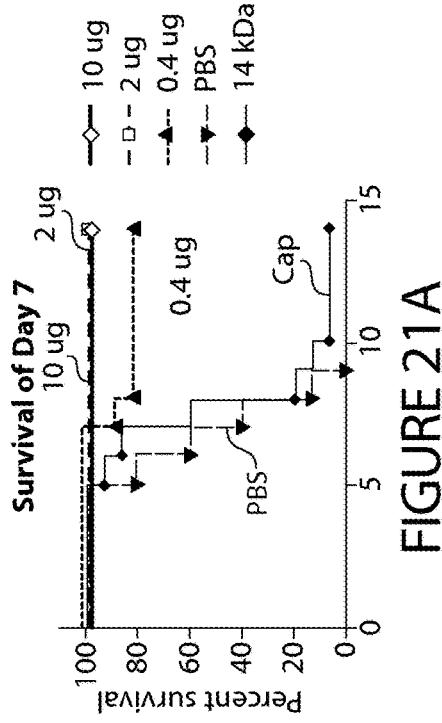
Figure 21D:
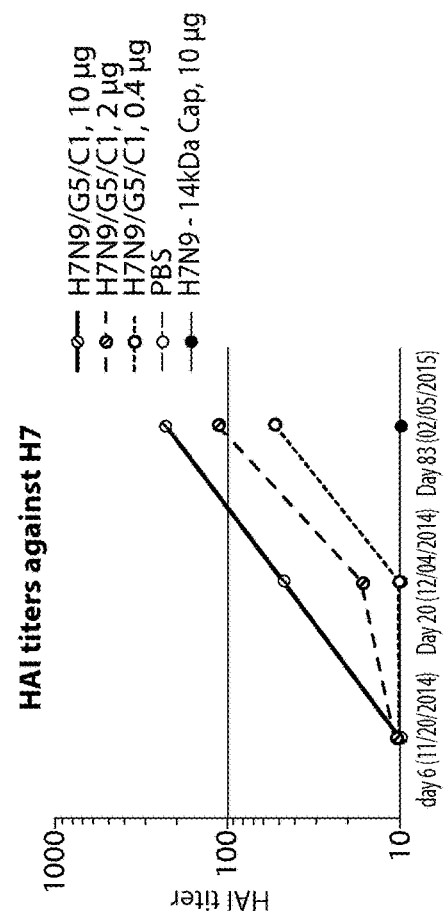
Figure 21C:
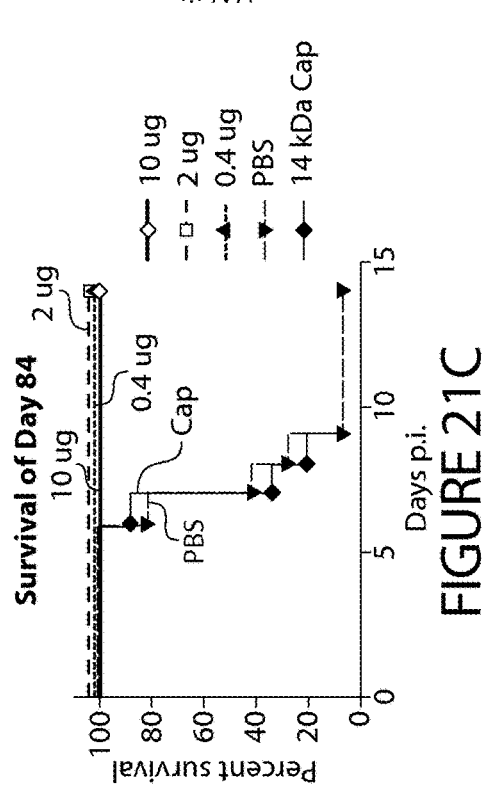

The lung homogenate data show that a single vaccination at any concentration resulted in a reduction in viral titers, with a time to onset of immunity before 7 days post vaccination (Table 46). There was a 1 log reduction in all vaccine groups challenged 7 days post vaccination. This improved for groups challenged 21 days post vaccination in a dose-dependent fashion to 3, 2, and 1 log reduction for the 200-, 50-, and 10-µg groups, respectively (FIG. 20). This further improved for groups challenged 49 days post vaccination to 4, 2, and 3 log reduction for the 200, 50-, and 10-µg groups, respectively. A statistically significant difference was observed relative to PBS control group at 7 days post vaccination in the 10- and 200-µg groups (p<0.05). The 50-µg dose group also tended towards reduced lung viral titers, but only had statistically significant differences from the PBS group when a boost was administered. This was likely due to the occasional outlying high viral titer sample, which increased the variability in this group.

TABLE 46

Virus Burden (TCID50 Group Geographic Means)

| | Nasal Wash | | | Lung Homogenate | | |
|---|---|---|---|---|---|---|
| | Day 7 | Day 21 | Day 49 | Day 7 | Day 21 | Day 49 |
| H7N9/N1-methyl pseudouridine/C1/MC3 200 µg | $3.7 \times 10^3$ | $3.1 \times 10^3$ | $3.3 \times 10^4$ | $3.0 \times 10^3$ | $4.6 \times 10^1$ | $8.0 \times 10^0$ |
| H7N9/N1-methyl pseudouridine/C1/MC3 50 µg | $2.4 \times 10^3$ | $1.6 \times 10^4$ | $6.7 \times 10^4$ | $2.0 \times 10^3$ | $5.9 \times 10^2$ | $9.7 \times 10^2$ |
| H7N9/N1-methyl pseudouridine/C1/MC3 10 µg | $3.7 \times 10^3$ | $8.1 \times 10^2$ | $1.0 \times 10^5$ | $2.3 \times 10^3$ | $2.9 \times 10^3$ | $6.2 \times 10^1$ |
| PBS | $6.0 \times 10^3$ | $2.9 \times 10^3$ | $1.7 \times 10^5$ | $3.8 \times 10^4$ | $3.2 \times 10^4$ | $2.1 \times 10^4$ |
| H7N9/MC3 (−14 kDa Cap) 200 µg | $1.4 \times 10^4$ | $1.5 \times 10^3$ | $3.6 \times 10^5$ | $7.9 \times 10^3$ | $1.6 \times 10^3$ | $4.8 \times 10^2$ |

† 158 is the lower limit of detection of the nasal wash $TCID_{50}$ assay. All below LLOQ values were assigned a value of 79 for producing the geomean values for nasal wash. 15.8 is the lower limit of detection of the lung homogenate $TCID_{50}$ assay. All below LLOQ values were assigned a value of 8 for producing the geomean values for nasal wash.

There was no statistical benefit observed from the boosting vaccination compared to a single vaccination, but this is likely due to the 2-4 log reduction in viral lung titers by 49 days seen in both the single vaccination and 2 (boost) vaccination groups (Table 47).

TABLE 47

Lung Virus Burden (TCID50 Group Geographic Means)- Boosted vs. Unboosted

| | Day 49 Unboosted | Day 49 with the Day 21 Boost |
|---|---|---|
| 200 µg Vaccine | $8.0 \times 10^0$ | $8.0 \times 10^0$ |
| 50 µg Vaccine | $9.7 \times 10^2$ | $8.0 \times 10^0$ |
| 10 µg Vaccine | $6.2 \times 10^1$ | $1.1 \times 10^2$ |
| PBS | $2.1 \times 10^4$ | $2.2 \times 10^4$ |
| Empty Vaccine Vector | $4.8 \times 10^2$ | $8.0 \times 10^0$ |

† 15.8 is the lower limit of detection of the lung homogenate $TCID_{50}$ assay. All below LLOQ values were assigned a value of 8 for producing the geomean values for nasal wash.

Serum was collected from each animal immediately before vaccination and challenge and analyzed by HAI assay. As seen from Table 48, a dose dependent increase was visible 7 days post vaccination, and titers increased over time. The 200-µg to 14-kDa cap vaccine did provide some titer above background, between the 10-µg vaccine and PBS response. The groups receiving a second vaccination showed a dose-dependent, 3 8 fold increase in antibody titers following the second vaccination. The 200-µg to 14-kDa cap vaccine also showed an approximately 2-fold increase in antibody titers following the second vaccination. In all cases, a statistically significant increase relative to the pre-vaccination blood sample was first observed 21 days post-vaccination (p<0.05).

TABLE 48

HAI Antibody Titer Results

| | | Geomean | | | |
|---|---|---|---|---|---|
| Cohort | Treatment | Day 0 | Day 7 | Day 21 | Day 49 |
| 1 | 200 µg Vaccine | 5.00† | 5.45 | N/A‡ | N/A |
| 1 | 50 µg Vaccine | 5.00 | 6.48 | N/A | N/A |
| 1 | 10 µg Vaccine | 5.00 | 5.94 | N/A | N/A |
| 1 | PBS | 5.00 | 5.00 | N/A | N/A |
| 1 | Empty Vaccine Vector | 5.00 | 5.45 | N/A | N/A |
| 2 | 200 µg Vaccine | 5.00 | N/A | 43.62 | N/A |
| 2 | 50 µg Vaccine | 5.00 | N/A | 25.94 | N/A |
| 2 | 10 µg Vaccine | 5.00 | N/A | 25.94 | N/A |

TABLE 48-continued

HAI Antibody Titer Results

| | | Geomean | | | |
|---|---|---|---|---|---|
| Cohort | Treatment | Day 0 | Day 7 | Day 21 | Day 49 |
| 2 | PBS | 5.00 | N/A | 5.00 | N/A |
| 2 | Empty Vaccine Vector | 5.00 | N/A | 9.35 | N/A |
| 3 | 200 µg Vaccine | 5.00 | N/A | N/A | 61.69 |
| 3 | 50 µg Vaccine | 5.00 | N/A | N/A | 33.64 |
| 3 | 10 µg Vaccine | 5.00 | N/A | N/A | 25.94 |
| 3 | PBS | 5.00 | N/A | N/A | 5.00 |
| 3 | Empty Vaccine Vector | 5.00 | N/A | N/A | 18.34 |
| 4 | 200 µg Vaccine | 5.00 | N/A | 59.93 | 480.67 |
| 4 | 50 µg Vaccine | 5.00 | N/A | 29.97 | 195.85 |
| 4 | 10 µg Vaccine | 5.00 | N/A | 40.00 | 97.92 |
| 4 | PBS | 5.00 | N/A | 5.00 | 5.45 |
| 4 | Empty Vaccine Vector | 5.94 | N/A | 5.96 | 36.68 |

†Ten is the lower limit of detection of the HAI assay. All <10 were assigned a value of 5 for producing the geomean values.
‡NA = Not applicable.

Serum samples were also analyzed by MN assay. As shown in Table 49, increases in MN titer was observed as early as 7 days post vaccination and continued to increase through 49 days post vaccination. The titers were highest in the 200-μg vaccine group, and were similar in the 50- and 10-μg groups. For the 50- and 200-μg vaccine dose groups, a statistically significant increase was observed by 7 days post-vaccination (p<0.05). For the 10-μg vaccine dose groups, the significant increase was not observed until 21 days post-vaccination (p<0.05). The 200 μg to 14-kDa cap vaccine did provide some titer above background, which was statistically significant by 49 days post vaccination (p<0.05) and were lower than the titers for the 50- and 10-μg groups. The groups receiving a second vaccination experienced a 3.0-4.5 fold increase in titers following the second vaccination. The 200 μg to 14-kDa cap vaccine also showed an approximately 1.5-fold increase in titers following the second vaccination.

10-μg full vaccine, but did reduce viral burden in the lung and increased antibody titers, both relative to PBS control.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification,

TABLE 49

MN Antibody Titer Results

| Cohort | Treatment | Geomean[†] | | | |
|---|---|---|---|---|---|
| | | Day 0 | Day 7 | Day 21 | Day 49 |
| 1 | H7N9/N1-methyl pseudouridine/C1/MC3 200 μg Vaccine | 15.00 | 33.67 | N/A[‡] | N/A |
| 1 | H7N9/N1-methyl pseudouridine/C1/MC3 50 μg Vaccine | 17.38 | 42.29 | N/A | N/A |
| 1 | H7N9/N1-methyl pseudouridine/C1/MC3 10 μg Vaccine | 21.21 | 25.94 | N/A | N/A |
| 1 | PBS | 19.58 | 18.47 | N/A | N/A |
| 1 | H7N9/MC3 (−14 kDa Cap) 200 ug | 17.43 | 20.03 | N/A | N/A |
| 2 | H7N9/N1-methyl pseudouridine/C1/MC3 200 μg Vaccine | 14.69 | N/A | 92.41 | N/A |
| 2 | H7N9/N1-methyl pseudouridine/C1/MC3 50 μg Vaccine | 17.49 | N/A | 42.50 | N/A |
| 2 | H7N9/N1-methyl pseudouridine/C1/MC3 10 μg Vaccine | 15.07 | N/A | 43.48 | N/A |
| 2 | PBS | 17.89 | N/A | 13.60 | N/A |
| 2 | H7N9/MC3 (−14 kDa Cap) 200 μg | 18.52 | N/A | 17.43 | N/A |
| 3 | H7N9/N1-methyl pseudouridine/C1/MC3 200 μg Vaccine | 15.51 | N/A | N/A | 160.08 |
| 3 | H7N9/N1-methyl pseudouridine/C1/MC3 50 μg Vaccine | 13.16 | N/A | N/A | 89.80 |
| 3 | H7N9/N1-methyl pseudouridine/C1/MC3 10 μg Vaccine | 13.12 | N/A | N/A | 77.51 |
| 3 | PBS | 12.70 | N/A | N/A | 10.68 |
| 3 | H7N9/MC3 (−14 kDa Cap) 200 μg | 10.33 | N/A | N/A | 46.21 |
| 4 | H7N9/N1-methyl pseudouridine/C1/MC3 200 μg Vaccine | 10.33 | N/A | 63.44 | 697.88 |
| 4 | H7N9/N1-methyl pseudouridine/C1/MC3 50 μg Vaccine | 10.68 | N/A | 29.99 | 273.04 |
| 4 | H7N9/N1-methyl pseudouridine/C1/MC3 10 μg Vaccine | 10.68 | N/A | 31.97 | 232.65 |
| 4 | PBS | 12.01 | N/A | 11.03 | 10.68 |
| 4 | H7N9/MC3 (−14 kDa Cap) 200 μg | 11.78 | N/A | 16.47 | 69.06 |

[†]20 is the lower limit of detection of the MN assay. All <20 were assigned a value of 10 for producing the geomean values.
[‡]N/A = Not applicable.

Quite surprisingly, the vaccine constructs of the invention reduced viral titers in the lungs when exposed to virus just 7 days following vaccination. Statistically significant increases in antibody titer as measured by HAI and MN were detected as early as 7 days following vaccination. A second vaccination (i.e., booster) did increase antibody titers, but did not statistically reduce the viral titer, as a single vaccination eliminated all virus in most animals. The −14 kDa cap vaccine at 200 μg/animal provided less protection than including definitions, will control. In addition, section headings, the materials, methods, and examples are illustrative only and not intended to be limiting.

It is to be understood that the words which have been used are words of description rather than limitation, and that changes may be made within the purview of the appended claims without departing from the true scope and spirit of the invention in its broader aspects.

LENGTHY TABLES

The patent contains a lengthy table section. A copy of the table is available in electronic form from the USPTO web site (http://seqdata.uspto.gov/?pageRequest=docDetail&DocID=US09872900B2). An electronic copy of the table will also be available from the USPTO upon request and payment of the fee set forth in 37 CFR 1.19(b)(3).

SEQUENCE LISTING (1027 sequences)

SEQ ID NO: 1 - protein, 349 aa, Influenza A virus
  misc_feature (1)..(349): AAM19228 A/turkey/Minnesota/38429/1988 1988// HA 20335017
ACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIITNGATSACRRSGSSFYAEMKWLLSNSDNAAFPQMTKSYRNPRNKPALIVWGIHHSGSTTEQTKLYGSGNKLITVESSKYQQSFTPSPGARPQVNGESGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIEKDGGSHYG

SEQ ID NO: 2 - protein, 560 aa, Influenza A virus
  misc_feature (1)..(560): AAY46211 A/mallard/Sweden/91/2002 2002// HA 66394828
MNTQILVFALVAIIPINADKICLGHHAVSNGTKVNTLTERGVEVVNATETVERTNVPRICSRGKRTVDLGQCGLLGTITGPPQCDQFLEFSADLIIERREGSDVCYPGKFVNEEALRQILRESGGIDKETMGFTYSGIRTNGAPSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 3 - protein, 560 aa, Influenza A virus
  misc_feature (1)..(560): ABI84694 A/turkey/Minnesota/1/1988 1988/07/13 HA 115278573
MNTQILVFIACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIRTNGATSACRRSGSSFYAEMKWLLSNSDNAAFPQMTKSYRNPRNKPALIVWGIHHSGSTTEQTKLYGSGNKLITVGSSKYQQSFTPSPGARPQVNGQSGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIENGWEGLIDGWYGFKHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRRQLRENAEEDGTGCFEIFHKCDDQCMESIRNNTYDHAQYRAESLQNRIQIDPVKLSSGYKDIILWFSFGASCFLLLAIAMGLVFICIKNGNMRCTICI

SEQ ID NO: 4 - protein, 560 aa, Influenza A virus
  misc_feature (1)..(560): ABS89409 A/blue-winged teal/Ohio/566/2006 2006// HA 155016324
MNTQILALIACMLIGAKGDKICLGHHAVANGTKVNTLTERGIEVVNATETVETANIKKICTQGKRPTDLGQCGLLGTLIGPPQCDQFLEFDTDLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVRLSSGYKDIILWFSFGASCFLLLAIAMGLVFICIKNGNMRCTICI

SEQ ID NO: 5 - protein, 560 aa, Influenza A virus
  misc_feature (1)..(560): ACD03594 A/ruddy turnstone/DE/1538/2000 2000// HA 187384848
MNTQILAFIACMLVGVRGDKICLGHHAVANGTKVNTLTEKGIEVVNATETVESANIKKICTQGKRPTDLGQCGLLGTLIGPPQCDQFLEFDSDLIIERREGTDVCYPGKFTNEESLRQILRGSGGIDKESMGFTYSGIRTNGATSACRRLGSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGIQSDVPLDSSCGGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELMDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLIFICIKNGNMRCTICI

SEQ ID NO: 6 - protein, 560 aa, Influenza A virus
  misc_feature (1)..(560): BAH22785 A/duck/Mongolia/119/2008 2008// HA 223717820
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIGKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRTVGKCPRYVKQESLLLATGMKNVPEIPKGRGLFGAIAGFIENGWEGLIDGWYGFRHQNAQGEGTAADYKSTQSAIDQITGKLNRLIERTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSNGYKDVILWFSFGASCFILLAIAMGLVFICVKNGNMRCTICI

SEQ ID NO: 7 - protein, 560 aa, Influenza A virus
  misc_feature (1)..(560): CAY39406 A/Anas crecca/Spain/1460/2008 2008/01/26 HA 254674376
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGTIISNLPFQNINSRAVGKCPRYVKQESLMLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 8 - protein, 560 aa, Influenza A virus
  misc_feature (1)..(560): ACX53683 A/goose/Czech Republic/1848-K9/2009 2009/02/04 HA 260907763
MNIQILVFALVAIIPTNADKICLGHHAVSNGTKVNTLTERGVEVVNATETVERTNVPRICSKGKRTVDLGQCGLLGTITGPPQCDQFLEFSADLIIERRGGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLKGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 9 - protein, 404 aa, Influenza A virus
  misc_feature (1)..(404): ACZ48625 A/turkey/Minnesota/38429/1988 1988// HA 269826341
MNTQILVFIACVLVEAKGDKICLGHHAVVNGTKVNTLTEKGIEVVNATETVETANIGKICTQGKRPTDLGQCGLLGTLIGPPQCDQFLEFESDLIIERREGNDVCYPGKFTNEESLRQILRGSGGIDKESMGFTYSGIRTNGATSACRRSGSSFYAEMKWLLSNSDNAAFPQMTKSYRNPRNKPALIVWGIHHSGSTTEQTKLYGSGNKLITVGSSKYQQSFTPSPGARPQVNGQSGRIDFHWMLLDPNDTVTFTFNGAFIAPDRASFFKGESLGVQSDVPLDSSCGGDCFHSGGTIVSSLPFQNINPRTVGKCPRYVKQPSLLLATGMRNVPENPKTRGLFGAIAGFIENGWEGLIDGWYGFKHQNAQGEGTAADYKSTQSAIDQITGKLNRLIDKTNQQFEL

SEQ ID NO: 10 - protein, 160 aa, Influenza A virus
  misc_feature (1)..(160): ADC29485 A/mallard/Spain/08.00991.3/2005 2005/11/ HA 284927336
STQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILL

SEQ ID NO: 11 - protein, 560 aa, Influenza A virus
  misc_feature (1)..(560): ADK71137 A/blue-winged teal/Guatemala/CIP049-01/2008 2008/02/07 HA 301333785
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSSYAEMKWLLSNSDNAAFPQMTKSYRNPRNKPALIIWGVHHSGSATEQTKLYGSGNKLITVGSSKYQQSFTPSPGTRPQVNGQSGRIDFHWLLLDPNDTVTFTFNGAFIAPDRASFLRGKSLGIQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQHFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 12 - protein, 560 aa, Influenza A virus
  misc_feature (1)..(560): ADK71148 A/blue-winged teal/Guatemala/CIP049-02/2008 2008/03/05 HA 301333804
  misc_feature (47)..(47): Xaa can be any naturally occurring amino acid
MNTQILALIACMLIGAKGDKICLGHHAVANGTKVNTLTERGIEVVNXTETVETANIKKICTHGKRPTDLGQCGLLGTLIGPPQCDRFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGTRPQVNGQSGRIDFHWLLLDPNDTVTFTFNGAFIAPDRASFLRGKSLGIQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 13 - protein, 560 aa, Influenza A virus
  misc_feature (1)..(560): ADN34727 A/goose/Czech Republic/1848-T14/2009 2009/02/04 HA 307141869
  misc_feature (143)..(143): Xaa can be any naturally occurring amino acid
MNIQILVFALVAIIPTNADKICLGHHAVSNGTKVNTLTERGVEVVNATETVERTNVPRICSKGKRTVDLGQCGLLGTITGPPQCDQFLEFSADLIIERRGGSDVCYPGKFVNEEALRQILRESGGIDKETMGFTYSGIRTNGXTSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLKGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 14 - protein, 303 aa, Influenza A virus
  misc_feature (1)..(303): AEK84760 A/wild bird/Korea/A14/2011 2011/02/ HA 341610308
PAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 15 - protein, 556 aa, Influenza A virus
  misc_feature (1)..(556): AEK84761 A/wild bird/Korea/A3/2011 2011/02/ HA 341610310
ILVFALVAIIPTNANKIGLGHHAVSNGTKVNTLTERGVEVFNATETVERTNVPRICSKGKKTVDLGQCGLRGTITGPPQCDQFLKFSPDLIIERQKGSDVCYPGKFVNEKPLRQILRESGGIDKETMGFAYNGIKTNGPPIACRKSGSSFYAKMKWLLSNTDKAAFPQMTKSYKNTRRNPALIVWGIHHSGSTTKQTKLYGIGSNLITVGSSNYQQSFVPSPGARPQVNGQSGRIDFHWLILNPNDTVTFSFNGAFIPPDRASFLRGKSMGIQSGVQVDASCEGDCYHSGGTIISNLPFQNINSRAVGKCPRYVKQESLMLATGMKNVPELPKGKGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 16 - protein, 556 aa, Influenza A virus
  misc_feature (1)..(556): AEK84763 A/wild bird/Korea/A9/2011 2011/02/ HA 341610314
ILVFALVAIIPTNANKIGLGHHAVSNGTKVNTLTERGVEFFNATETVEPTNVPRICSKGKKTVDLGQCGLLGTITGPPQCDQFLEFSADLIIERREGSDVCYPGKFVNEKALRQILRESGGIDKETMGFAYSGIKTNGPPIACRKSGSSFYAKMKWLLSNTDKAAFPQMTKSYKNIRRDPALIVWGIHHSGSTTKQTNLYGIGSNLITVGSSNYQQSFVPSPGARPQVNGQSGRIDFHWLILNPNDTVTFIFNGAFIAPDRASFLIGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 17 - protein, 555 aa, Influenza A virus
  misc_feature (1)..(555): AEK84765 A/spot-billed duck/Korea/447/2011 2011/04/ HA 341610318
LVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMARIRNNTYDHSKYREEAMQNRIQIDPVKLSSGYKDVILWFSFGASCFILLAIAMGLVFICVKNGNMRCTICI

SEQ ID NO: 18 - protein, 555 aa, Influenza A virus
  misc_feature (1)..(555): AEM98291 A/wild duck/Mongolia/1-241/2008 2008/04/ HA 344196120
SILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGSIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTI

SEQ ID NO: 19 - protein, 557 aa, Influenza A virus
  misc_feature (1)..(557): AFM09439 A/emperor goose/Alaska/44063-061/2006 2006/05/23 HA 390535062
QILAFIACMLIGAKGDKICLGHHAVANGTKVNTLTERGIEVVNATETVETVNIKKICTQGKRPTDLGQCGLLGTLIGPPQCDQFLEFDADLIIERRKGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFVPSPGARPQVNGQSGRIDFHWLLLDPNDTVTFTFNGAFIAPERASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQINPVKLSSGYKDIILWFSFGASCFLLLAIAMGLVFICIKNGNMRCTICI

SEQ ID NO: 20 - protein, 560 aa, Influenza A virus
  misc_feature (1)..(560): AFV33945 A/guinea fowl/Nebraska/17096-1/2011 2011/04/05 HA 409676820
MNTQILALIACMLIGAKGDKICLGHHAVANGTKVNTLTERRIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 21 - protein, 560 aa, Influenza A virus
  misc_feature (1)..(560): AFV33947 A/goose/Nebraska/17097-4/2011 2011/04/05 HA 409676827
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIVWGVHHSASATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 22 - protein, 560 aa, Influenza A virus
  misc_feature (1)..(560): AFX85260 A/ruddy turnstone/Delaware Bay/220/1995 1995/05/21 HA 423514912
MNTQILAFIACMLIGINGDKICLGHHAVANGTKVNTLTERGIEVVNATETVETANIKRICTQGKRPIDLGQCGLLGTLIGPPQCDQFLEFDSDLIIERREGTDVCYPGKFTNEESLRQILRGSGGIDKESMGFTYSGIRTNGATSACIRLGSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGVQSDVPLDSSCGGDCFHSGGTIVSSLPFQNINPRTVGRCPRYVKQTSLLLATGMKNVPENPKTRGLFGAIAGFIENGWEGLIDGWYGFRHQNAQGEGTAADYKSTQSAIDQITGKLNRLIDKTNQQFELIDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 23 - protein, 560 aa, Influenza A virus
  misc_feature (1)..(560): AGE08098 A/northern shoverl/Mississippi/11OS145/2011 2011/01/08 HA 444344488
MNTQILTLIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHNGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 24 - protein, 560 aa, Influenza A virus
  misc_feature (1)..(560): AGI60301 A/Hangzhou/1/2013 2013/03/24 HA 475662454
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGISGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 25 - protein, 560 aa, Influenza A virus
  misc_feature (1)..(560): AGI60292 A/Shanghai/4664T/2013 2013/03/05 HA 476403560
MNTQILVFALIAIIPANADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCHHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 26 - protein, 560 aa, Influenza A virus
  misc_feature (1)..(560): AGJ72861 A/chicken/Zhejiang/DTID-ZJU01/2013 2013/04/ HA 479280294
MNTQILVFALIAIIPTNADKICLGHHAVSNGTKVNTLTERGGEVVNATETVERTNIPRICSKGKKTVDLGQGGPRGTITGPPQCDQFLEFSADLIMERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 27 - protein, 560 aa, Influenza A virus
  misc_feature (1)..(560): AGJ73503 A/Nanjing/1/2013 2013/03/28 HA 479285761
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 28 - protein, 560 aa, Influenza A virus
  misc_feature (1)..(560): BAN16711 A/duck/Gunma/466/2011 2011// HA 482661571
MNTQVLVFALMAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRRDPALIAWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDDTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 29 - protein, 560 aa, Influenza A virus
  misc_feature (1)..(560): AGK84857 A/Hangzhou/2/2013 2013/04/01 HA 485649824
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQITKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 30 - protein, 560 aa, Influenza A virus
  misc_feature (1)..(560): AGL44438 A/Shanghai/02/2013 2013/03/05 HA 496493389
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 31 - protein, 206 aa, Influenza A virus
  misc_feature (1)..(206): AGL33692 A/Shanghai/4655T/2013 2013/02/26 HA 491874175
GMIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 32 - protein, 206 aa, Influenza A virus
  misc_feature (1)..(206): AGL33693 A/Shanghai/4659T/2013 2013/02/27 HA 491874186
GMIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 33 - protein, 549 aa, Influenza A virus
  misc_feature (1)..(549): AGL95088 A/Taiwan/S02076/2013 2013/04/22 HA 501485301
VFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMR

SEQ ID NO: 34 - protein, 552 aa, Influenza A virus
  misc_feature (1)..(552): AGL95098 A/Taiwan/T02081/2013 2013/04/22 HA 501485319
LVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 35 - protein, 196 aa, Influenza A virus
  misc_feature (1)..(196): AGM53883 A/Shanghai/5083T/2013 2013/04/20 HA 507593986
GFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 36 - protein, 193 aa, Influenza A virus
  misc_feature (1)..(193): AGM53884 A/Shanghai/5180T/2013 2013/04/23 HA 507593988
AQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 37 - protein, 192 aa, Influenza A virus
  misc_feature (1)..(192): AGM53885 A/Shanghai/5240T/2013 2013/04/25 HA 507593990
QNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 38 - protein, 191 aa, Influenza A virus
  misc_feature (1)..(191): AGM53886 A/Shanghai/4842T/2013 2013/04/13 HA 507593992
NAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 39 - protein, 193 aa, Influenza A virus
  misc_feature (1)..(193): AGM53887 A/Shanghai/4701T/2013 2013/04/06 HA 507593994
NAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTIC

SEQ ID NO: 40 - protein, 560 aa, Influenza A virus
  misc_feature (1)..(560): AGN69462 A/Wuxi/2/2013 2013/03/31 HA 511105778
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGSTSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 41 - protein, 560 aa, Influenza A virus
  misc_feature (1)..(560): AGN69474 A/Wuxi/1/2013 2013/03/31 HA 511105798
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLINGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 42 - protein, 560 aa, Influenza A virus
  misc_feature (1)..(560): AGO51387 A/Jiangsu/2/2013 2013/04/20 HA 514390990
  misc_feature (503)..(503): Xaa can be any naturally occurring amino acid
  misc_feature (507)..(507): Xaa can be any naturally occurring amino acid
  misc_feature (508)..(508): Xaa is Asn or Asp
  misc_feature (509)..(509): Xaa can be any naturally occurring amino acid
  misc_feature (525)..(525): Xaa can be any naturally occurring amino acid
  misc_feature (526)..(526): Xaa is Ile or Leu
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYRXEAMXXXIQIDPVKLSSGYKDVXXWFSFGASCFILLAIVMGLVFICVKNGNMRCTICI

SEQ ID NO: 43 - protein, 560 aa, Influenza A virus
  misc_feature (1)..(560): BAN59726 A/duck/Mongolia/147/2008 2008/08/29 HA 519661951
MNTQILVFALVAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIGKETMGFTYSGIRTNGATSACRRSRSSFYAEMKWLLSNTDNAAFPQMTRSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRTVGKCPRYVKQESLLLATGMKNVPEIPKGRGLFGAIAGFIENGWEGLIDGWYGFRHQNAQGEGTAADYKSTQSAIDQITGKLNRLIERTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSNGYKDVILWFSFGASCFILLAIAMGLVFICVKNGNMRCTICI

SEQ ID NO: 44 - protein, 560 aa, Influenza A virus
  misc_feature (1)..(560): BAN59727 A/duck/Mongolia/129/2010 2010// HA 519661954
MNTQILVFALVAIIPTNADKICLGHHAVSNGTKVNTLTERGVEVVNATETVERINVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMRCTICI

SEQ ID NO: 45 - protein, 560 aa, Influenza A virus
  misc_feature (1)..(560): AGQ80952 A/duck/Jiangxi/3096/2009 2009// HA 523788794
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGSSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 46 - protein, 560 aa, Influenza A virus
  misc_feature (1)..(560): AGQ80989 A/duck/Jiangxi/3257/2009 2009// HA 523788868
  misc_feature (215)..(215): Xaa can be any naturally occurring amino acid
MNTQILVFALVAIIPTNADKICLGHHAVSNGTKVNTLTERGVEVVNATETVERTSIPRICSKGKRAVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQTTKSYKNTRKDPALIIWGIHHSGSTTEQTKLYGSGNKLITVGXSNYQQSFVPSPGARPQVNGQSGRIDFHWLMLNPNDTVTFSFNGAFIAPDRASFLRGKSMGIQSGVQVDANCEGDCYHNGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 47 - protein, 560 aa, Influenza A virus
  misc_feature (1)..(560): AGQ81043 A/chicken/Rizhao/515/2013 2013// HA 523788976
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEEMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 48 - protein, 560 aa, Influenza A virus
  misc_feature (1)..(560): AGR33894 A/chicken/Rizhao/719b/2013 2013// HA 524845213
  misc_feature (510)..(521): Xaa can be any naturally occurring amino acid
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDRSKYREEAMQNRXXXXXXXXXXXXKDVILWFSFGASCFILLAIVMGLVFICVKNGNMRCTICI

SEQ ID NO: 49 - protein, 560 aa, Influenza A virus
  misc_feature (1)..(560): AGR49399 A/chicken/Jiangxi/SD001/2013 2013/05/03 HA 525338528
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 50 - protein, 560 aa, Influenza A virus
  misc_feature (1)..(560): AGR49495 A/chicken/Shanghai/S1358/2013 2013/04/03 HA 525338689
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIKNNTYDHSKYREEAMQNRIQIDPVKLSSGYKDVILWFSFGASCFILLAIVMGLVFICVKNGNMRCTICI

SEQ ID NO: 51 - protein, 560 aa, Influenza A virus
  misc_feature (1)..(560): AGR49506 A/chicken/Shanghai/S1410/2013 2013/04/03 HA 525338708
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 52 - protein, 560 aa, Influenza A virus
  misc_feature (1)..(560): AGR49554 A/chicken/Zhejiang/SD033/2013 2013/04/11 HA 525338789
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVRRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 53 - protein, 560 aa, Influenza A virus
  misc_feature (1)..(560): AGR49566 A/duck/Anhui/SC702/2013 2013/04/16 HA 525338809
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDNRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 54 - protein, 560 aa, Influenza A virus
  misc_feature (1)..(560): AGR49722 A/homing pigeon/Jiangsu/SD184/2013 2013/04/20 HA 525339071
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSEIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 55 - protein, 560 aa, Influenza A virus
  misc_feature (1)..(560): AGR49734 A/pigeon/Shanghai/S1069/2013 2013/04/02 HA 525339091
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTITFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 56 - protein, 560 aa, Influenza A virus
  misc_feature (1)..(560): AGR49770 A/wild pigeon/Jiangsu/SD001/2013 2013/04/17 HA 525339151
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 57 - protein, 560 aa, Influenza A virus
  misc_feature (1)..(560): AGY41893 A/Huizhou/01/2013 2013/08/08 HA 552049496
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 58 - protein, 553 aa, Influenza A virus
  misc_feature (1)..(553): AGY42258 A/mallard/Sweden/91/2002 2002/12/12 HA 552052155
  misc_feature (72)..(72): Xaa can be any naturally occurring amino acid
  misc_feature (137)..(137): Xaa can be any naturally occurring amino acid
FALVAIIPINADKICLGHHAVSNGTKVNTLTERGVEVVNATETVERTNVPRICSRGKRTVDLGQCGLLGTIXGPPQCDQFLEFSADLIIERREGSDVCYPGKFVNEEALRQILRESGGIDKETMGFTYSGIRTNGAXSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 59 - protein, 560 aa, Influenza A virus
  misc_feature (1)..(560): AHA11441 A/guinea fowl/Nebraska/17096/2011 2011/04/10 HA 557478572
MNTQILALIACMLIGAKGDKICLGHHAVANGTKVNTLTERGIEVVNATETVETANIKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 60 - protein, 560 aa, Influenza A virus
  misc_feature (1)..(560): AHA11452 A/turkey/Minnesota/32710/2011 2011/07/12 HA 557478591
MNTQILALIACMLVGTKGDKICLGHHAVANGTKVNTLTERGIEVVNATETVETANIKKICTQGKRPTDLGQCGLLGTLIGPPQCDQFLEFDADLIIERREGTDVCYPGKFTNEEPLRQILRGSGGIDKESMGFTYSGIRTNGATSTCRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFEMIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 61 - protein, 560 aa, Influenza A virus
  misc_feature (1)..(560): AHA11461 A/turkey/Minnesota/31900/2011 2011/07/05 HA 557478606
MNTQILALIACMLVGTKGDKICLGHHAVANGTKVNTLTERGIEVVNATETVETANIKKICTQGKRPTDLGQCGLLGTLIGPPQCDQFLEFDADLIIERREGTDVCYPGKFTNEEPLRQILRGSGGIDKESMGFTYSGIRTNGATSTCRRSGSSFYAEMKWLLSNSNNAAFPQMTKSYRNPRNKPALIVWGVHHSGSATEQTKLYGSGSKLITVGSSKYQQSFTPSPGARPQVNGQSGRIDFHWLLLDPNDTVTFTFNGAFIAPDRASFFRGESLGVQSDVPLDSGCEGDCFHKGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTEIWSYNAELLVAMENQHTIDLADSEMNKLYERVRKQLRENAEEDGTGCFEIFHKCDDQCMESIRNNTYDHTQYRAESLQNRIQIDPVKLSSGYKDIILWFSFGASCFLLLAIAMGLVFICIKNGNMRCTICI

SEQ ID NO: 62 - protein, 560 aa, Influenza A virus
  misc_feature (1)..(560): AHK10585 A/chicken/Guangdong/G1/2013 2013/05/05 HA 587680636
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 63 - protein, 560 aa, Influenza A virus
  misc_feature (1)..(560): AGG53366 A/wild duck/Korea/CSM42-34/2011 2011/03/ HA 459252887
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGLTYSGIRTNGATSACRRSGSSFYAEMKWLLSNTDNAAFPQMTKSYKNTRRDPALIVWGIHHSGSSTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVRLSSGYKDVILWFSFGASCFILLAIAMGLVFICVKNGNMRCTICI

SEQ ID NO: 64 - protein, 557 aa, Influenza A virus
  misc_feature (1)..(557): AGG53377 A/wild duck/Korea/CSM42-1/2011 2011/03/ HA 459252925
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGLTYSGIRTNGATSACRRSGSSFYAEMKWLLSNTDNAAFPQMTKSYKNTRRDPALIVWGIHHSGSSTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVRLSSGYKDVILWFSFGASCFILLAIAMGLVFICVKNGNMRCT

SEQ ID NO: 65 - protein, 560 aa, Influenza A virus
  misc_feature (1)..(560): AGG53399 A/wild duck/Korea/MHC39-26/2011 2011/03/ HA 459253005
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 66 - protein, 557 aa, Influenza A virus
  misc_feature (1)..(557): AGG53432 A/wild duck/Korea/MHC35-41/2011 2011/03/ HA 459253136
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPEPPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCT

SEQ ID NO: 67 - protein, 558 aa, Influenza A virus
  misc_feature (1)..(558): AGG53476 A/wild duck/Korea/SH19-27/2010 2010/12/ HA 459253257
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTI

SEQ ID NO: 68 - protein, 560 aa, Influenza A virus
  misc_feature (1)..(560): AGG53487 A/wild duck/Korea/SH19-50/2010 2010/01/ HA 459253278
MNTQILVFALVAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRRDPALIVWGIHHSGSTTEQTKLYGSGSKLITVGSSNYQQSFVPSPGARPQVNGQSGRIDFHWLILNPNDTVTFSFNGAFIAPDRASFLRGKSMGIQSGVQVDASCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 69 - protein, 552 aa, Influenza A virus
  misc_feature (1)..(552): AGG53520 A/wild duck/Korea/SH20-27/2008 2008/12/ HA 459253409
QILVFALVAIIPTNADKICLGHHAVSNGTKVNTLTERGVEVVNATETVERTNVPRICSKGKRTVDLGQCGLLGTITGPPQCDQLLEFSADLIIERREGTDVCYPGKFVNEEALRQILRESGGIEKETMGFTYSGIRTNGATSACRRSGSSFYAEMKWLLSNTDNAAFPQMTKSYKNTRKDPALIIWGIHHSGSTTEQTKLYGSGSKLITVGSSNYQQSFVPSPGARPQVNGQSGRIDFHWLMLNPNDTVTFSFNGAFIAPDRASFLRGKSMGIQSGVQVDANCEGDCYHSGGTIISNLPFQNINSRAVGKCPRYVKQESLMLATGMKNVPELPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQINPVKLSSGYKDVILWFSFGASCFILLAIAMGLVFICVKNGNMR

SEQ ID NO: 70 - protein, 560 aa, Influenza A virus
  misc_feature (1)..(560): AGL43637 A/Taiwan/1/2013 2013// HA 496297389
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGPSGRIDFHWLMLNPNDTVTFSFNGAFIAPDRASFLRGKSMGIQSGVQVDANCEGDCYHSGGTIINNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 71 - protein, 510 aa, Influenza A virus
  misc_feature (1)..(510): AGL97639 A/mallard/Minnesota/AI09-3770/2009 2009/09/12 HA 505555371
IACMLVGAKGDKICLGHHAVANGTKVNTLTERGIEVVNATETVETANIKKLCTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTELWSYNAELLVAMENQHTIDLADSEMNKLYERVRKQLRENAEEDGTGCFEIFHKCDDQCMESIRNNTYDHTQYRTESLQNRIQIDPVKLS

SEQ ID NO: 72 - protein, 560 aa, Influenza A virus
  misc_feature (1)..(560): AGO02477 A/Xuzhou/1/2013 2013/04/25 HA 512403688
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 73 - protein, 560 aa, Influenza A virus
  misc_feature (1)..(560): AGR84942 A/Suzhou/5/2013 2013/04/12 HA 526304561
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGSKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 74 - protein, 560 aa, Influenza A virus
  misc_feature (1)..(560): AGR84954 A/Nanjing/6/2013 2013/04/11 HA 526304594
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNRNMRCTICI

SEQ ID NO: 75 - protein, 560 aa, Influenza A virus
  misc_feature (1)..(560): AGR84978 A/Wuxi/4/2013 2013/04/07 HA 526304656
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 76 - protein, 560 aa, Influenza A virus
  misc_feature (1)..(560): AGR84990 A/Wuxi/3/2013 2013/04/07 HA 526304688
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 77 - protein, 560 aa, Influenza A virus
  misc_feature (1)..(560): AGR85002 A/Zhenjiang/1/2013 2013/04/07 HA 526304708
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNKRCTICI

SEQ ID NO: 78 - protein, 560 aa, Influenza A virus
  misc_feature (1)..(560): AGR85026 A/Nanjing/2/2013 2013/04/05 HA 526304762
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKSRNMRCTICI

SEQ ID NO: 79 - protein, 552 aa, Influenza A virus
  misc_feature (1)..(552): AGU02230 A/Zhejiang/DTID-ZJU05/2013 2013/04/ HA 532808765
LVFALIAIIPTNADKICLGHHAVSNGTKVNTLTERGGEVVNATETVERTNIPRICSKGKRTVDLGQCGLRGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 80 - protein, 550 aa, Influenza A virus
  misc_feature (1)..(550): AGU02233 A/Zhejiang/DTID-ZJU08/2013 2013/04/ HA 532808788
FALIAIIPTNADKICLGHHAVSNGTKVNTLTERGGEVVNATETVERTNFPRICSKGKRTVDLGQCGLRGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCT

SEQ ID NO: 81 - protein, 560 aa, Influenza A virus
  misc_feature (1)..(560): AGW82588 A/tree sparrow/Shanghai/01/2013 2013/05/09 HA 546235348
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTIGI

SEQ ID NO: 82 - protein, 552 aa, Influenza A virus
  misc_feature (1)..(552): AGW82600 A/Shanghai/CN01/2013 2013/04/11 HA 546235368
ALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSRSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIMSNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 83 - protein, 560 aa, Influenza A virus
  misc_feature (1)..(560): AGW82612 A/Shanghai/JS01/2013 2013/04/03 HA 546235388
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKNPALIVWGIHHSGSTAEQTKLYGSGNKLVTVGSSNYQQSFAPSPGARTQVNGQSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 84 - protein, 560 aa, Influenza A virus
  misc_feature (1)..(560): AHA11472 A/turkey/Minnesota/31676/2009 2009/12/08 HA 557478625
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGETSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITNKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 85 - protein, 560 aa, Influenza A virus
  misc_feature (1)..(560): AHA11483 A/turkey/Minnesota/14135-2/2009 2009/08/07 HA 557478644
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITSKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 86 - protein, 549 aa, Influenza A virus
  misc_feature (1)..(549): AHA11500 A/Zhejiang/DTID-ZJU10/2013 2013/10/14 HA 557478676
TQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPPVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKN

SEQ ID NO: 87 - protein, 560 aa, Influenza A virus
  misc_feature (1)..(560): AHA57050 A/turkey/Minnesota/14659/2009 2009/08/12 HA 558484427
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNNAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITSKLNRLIDKTNQQFELIDNEFSEIEQQIGNVINWTRDSMTEVWSYNAELLVAMENQHTIDLADSEMNKLYERVRKQLRENAEEDGTGCFEIFHNCDDQCMESIRNNTYDHTQYRKESLQNRIQIDPVKLSSGYKDIILWFSFGASCFLLLAIAMGLVFICIKNGNMRCTICI

SEQ ID NO: 88 - protein, 560 aa, Influenza A virus
  misc_feature (1)..(560): AHA57072 A/turkey/Minnesota/18421/2009 2009/09/09 HA 558484465
MNTQILALIACMLIGAKGDKICLGHHAVANGTKVNTLTERGIEVVNATETVETANVKKICTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSNDAAFPQMTKSYRNPRDKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPEKPKTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRKESLQNRIQIDPVKLSSGYKDIILWFSFGASCFLLLAIAMGLVFICIKNGNMRCTICI

SEQ ID NO: 89 - protein, 554 aa, Influenza A virus
  misc_feature (1)..(554): AHD25003 A/Guangdong/02/2013 2013/10/ HA 568260567
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNM

SEQ ID NO: 90 - protein, 560 aa, Influenza A virus
  misc_feature (1)..(560): AHF20528 A/Hong Kong/470129/2013 2013/11/30 HA 570933555
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 91 - protein, 560 aa, Influenza A virus
  misc_feature (1)..(560): AHF20568 A/Shanghai/CN02/2013 2013/04/02 HA 570933626
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIMSNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 92 - protein, 560 aa, Influenza A virus
  misc_feature (1)..(560): AHH25185 A/Guangdong/04/2013 2013/12/16 HA 576106234
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 93 - protein, 560 aa, Influenza A virus
  misc_feature (1)..(560): AHJ57411 A/Shanghai/PD-01/2014 2014/01/17 HA 585478041
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVSSPGARPQVNGLSGRIDFHWLMLNPNDTVTFSFNGAFIAPDRASFLRGKSMGIQSGVQVDANCKGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 94 - protein, 560 aa, Influenza A virus
  misc_feature (1)..(560): AHJ57418 A/Shanghai/PD-02/2014 2014/01/17 HA 585478256
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDICYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLKGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 95 - protein, 560 aa, Influenza A virus
  misc_feature (1)..(560): AHK10800 A/Shanghai/01/2014 2014/01/03 HA 587681014
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 96 - protein, 560 aa, Influenza A virus
  misc_feature (1)..(560): AHM24224 A/Beijing/3/2013 2013/04/16 HA 594704802
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVKEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 97 - protein, 560 aa, Influenza A virus
  misc_feature (1)..(560): AHN96472 A/chicken/Shanghai/PD-CN-02/2014 2014/01/21 HA 602701641
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 98 - protein, 560 aa, Influenza A virus
  misc_feature (1)..(560): AHZ39686 A/Anhui/DEWH72-01/2013 2013// HA 632807036
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 99 - protein, 560 aa, Influenza A virus
  misc_feature (1)..(560): AHZ39710 A/Anhui/DEWH72-03/2013 2013// HA 632807076
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTDGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 100 - protein, 560 aa, Influenza A virus
  misc_feature (1)..(560): AHZ39746 A/Anhui/DEWH72-06/2013 2013// HA 632807136
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGERPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 101 - protein, 560 aa, Influenza A virus
  misc_feature (1)..(560): AHZ41929 A/mallard/Sweden/1621/2002 2002/12/12 HA 632810949
MNTQILVFALVAIIPINADKICLGHHAVSNGTKVNTLTERGVEVVNATETVERTNVPRICSRGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRNDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQIDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVRRQLRENAEEDGTGCFEIFHKCDDDCMASIRNNTYDHSKYREEAMQNRIQIDPVKLSSGYKDVILWFSFGASCFILLAIAMGLVFMCVKNGNMRCTICI

SEQ ID NO: 102 - protein, 560 aa, Influenza A virus
  misc_feature (1)..(560): AHZ42537 A/mallard/Minnesota/AI09-3770/2009 2009/09/12 HA 632811964
MNTQILAFIACMLVGAKGDKICLGHHAVANGTKVNTLTERGIEVVNATETVETANIKKLCTQGKRPTDLGQCGLLGTLIGPPQCDQFLEFDADLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELIDNEFSEIEQQIGNVINWTRDSMTELWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 103 - protein, 561 aa, Influenza A virus
  misc_feature (1)..(561): AHZ42549 A/ruddy turnstone/Delaware/AI00-1538/2000 2000/05/20 HA 632811984
MNTQILAFIACMLVGVRGDKICLGHHAVANGTKVNTLTEKGIEVVNATETVESANIKKICTQGKRPTDLGQCGLLGTLIGPPQCDQFLEFDSDLIIERREGTDVCYPGKFTNEESLRQILRGSGGIDKESMGFTYSGIRTNGATSACRRLGSSSFYAEMKWLLSNSDNAAFPQMTKSYRNPRNKPALIIWGVHHSGSANEQTKLYGSGNKLITVGSSKYQQSFTPSPGARPQVNGQSGRIDFHWLLLDPNDTVTFTFNGAFIAPDRASFFRGESLGIQSDVPLDSSCGGDCFHSGGTIVSSLPFQNINPRTVGKCPRYVKQTSLLLATGMRNVPENPKTRGLFGAIAGFIENGWEGLIDGWYGFRHQNAQGEGTAADYKSTQSAIDQITGKLNRLIDKTNQQFELMDNEFNEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLIFICIKNGNMRCTICI

SEQ ID NO: 104 - protein, 560 aa, Influenza A virus
  misc_feature (1)..(560): AID70634 A/Shanghai/Mix1/2014 2014/01/03 HA 660304650
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRIIEKTNQQFELIDNEFNEVEKQISNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 105 - protein, 560 aa, Influenza A virus
  misc_feature (1)..(560): AIN76383 A/Zhejiang/LS01/2014 2014/02/08 HA 684694637
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 106 - protein, 560 aa, Influenza A virus
  misc_feature (1)..(560): AIU46619 A/chicken/Zhejiang/DTID-ZJU06/2013 2013/12/ HA 699978931
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVEVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 107 - protein, 560 aa, Influenza A virus
  misc_feature (1)..(560): AIU47013 A/chicken/Suzhou/040201H/2013 2013/04/ HA 699979673
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDMILWFSFGASCFILLAIVMGLVFICVKNGNMRCTICI

SEQ ID NO: 108 - protein, 560 aa, Influenza A virus
  misc_feature (1)..(560): AJJ90490 A/chicken/Shenzhen/742/2013 2013/12/10 HA 755178094
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 109 - protein, 560 aa, Influenza A virus
  misc_feature (1)..(560): AJJ90526 A/chicken/Shenzhen/898/2013 2013/12/09 HA 755178154
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 110 - protein, 560 aa, Influenza A virus
  misc_feature (1)..(560): AJJ90538 A/silkie chicken/Shenzhen/918/2013 2013/12/09 HA 755178174
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 111 - protein, 560 aa, Influenza A virus
  misc_feature (1)..(560): AJJ90576 A/chicken/Shenzhen/1665/2013 2013/12/12 HA 755178238
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 112 - protein, 560 aa, Influenza A virus
  misc_feature (1)..(560): AJJ90588 A/chicken/Shenzhen/2110/2013 2013/12/13 HA 755178258
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 113 - protein, 560 aa, Influenza A virus
  misc_feature (1)..(560): AJJ90661 A/chicken/Dongguan/2912/2013 2013/12/18 HA 755178380
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 114 - protein, 560 aa, Influenza A virus
  misc_feature (1)..(560): AJJ90673 A/silkie chicken/Dongguan/3049/2013 2013/12/18 HA 755178400
MNTQILVFALTAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 115 - protein, 560 aa, Influenza A virus
  misc_feature (1)..(560): AJJ90795 A/silkie chicken/Dongguan/3281/2013 2013/12/18 HA 755178604
MNTQILVFALIAIIPTNADKICLGHHAVPNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 116 - protein, 560 aa, Influenza A virus
  misc_feature (1)..(560): AJJ90891 A/silkie chicken/Dongguan/3520/2013 2013/12/19 HA 755178764
  misc_feature (183)..(183): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKXPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 117 - protein, 560 aa, Influenza A virus
  misc_feature (1)..(560): AJJ90951 A/chicken/Dongguan/3544/2013 2013/12/19 HA 755178864
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYRNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 118 - protein, 560 aa, Influenza A virus
  misc_feature (1)..(560): AJJ91035 A/chicken/Shenzhen/3780/2013 2013/12/19 HA 755179004
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRRSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDNRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 119 - protein, 560 aa, Influenza A virus
  misc_feature (1)..(560): AJJ91155 A/chicken/Dongguan/4037/2013 2013/12/19 HA 755179204
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 120 - protein, 560 aa, Influenza A virus
  misc_feature (1)..(560): AJJ92005 A/chicken/Shenzhen/801/2013 2013/12/09 HA 755180629
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 121 - protein, 560 aa, Influenza A virus
  misc_feature (1)..(560): AJJ94254 A/chicken/Dongguan/1374/2014 2014/02/21 HA 755184382
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 122 - protein, 560 aa, Influenza A virus
  misc_feature (1)..(560): AJJ94606 A/chicken/Dongguan/191/2014 2014/02/20 HA 755184968
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 123 - protein, 560 aa, Influenza A virus
  misc_feature (1)..(560): AJJ96552 A/chicken/Jiangxi/12206/2014 2014/03/16 HA 755188219
MNTQILVFALIAIIPTNADKICLGHHAVSNGTKVNTLTERGVEVVNATETVERTNIPRICSKGKKTIDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHNKYREEAMQNRIQIDPVKLSSGYKDVILWFSFGASCFILLAIVMGLVFICVKNGNMRCTICI

SEQ ID NO: 124 - protein, 560 aa, Influenza A virus
  misc_feature (1)..(560): AJJ96684 A/chicken/Jiangxi/13207/2014 2014/03/30 HA 755188439
MNTQILVFALIAIIPTNADKICLGHHAVSNGTKINTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 125 - protein, 560 aa, Influenza A virus
  misc_feature (1)..(560): AJJ96732 A/chicken/Jiangxi/13223/2014 2014/03/30 HA 755188519
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 126 - protein, 560 aa, Influenza A virus
  misc_feature (1)..(560): AJK00354 A/duck/Zhejiang/LS02/2014 2014/01/12 HA 755194469
MNTQILVFALVAIIPTNADKICLGHHAVSNGTKVNTLTERGVEVVNATETVERTNIPRICSKGKKTVDLGQCGLLGTITGPPQCDQFLEFSADLIVERREGSDVCYPGKFVNEEALRQILRESGGIDKEAMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPLVNGQSGRIDFHWLMLNPNDTVTFSFNGAFIAPDRASFLRGKSMGIQSGVQVDANCEGDCYHSGGTIISNLPFQNINSRAVGKCPRYVKQESLLLATGMKNVPEVPKGRGLFGAIAGFIENGWEGLIDGWYGFRHQNAQGEGTAADYKSTQSAIDQVTGKLNRLIEKTNQQFELIDHEFTEVEKQIGNVINWTRDSMTEVWSYNAELLVAMENQHTIDLADSEMNKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 127 - protein, 560 aa, Influenza A virus
  misc_feature (1)..(560): AJJ91264 A/silkie chicken/Dongguan/4129/2013 2013/12/19 HA 755179386
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLMEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 128 - protein, 560 aa, Influenza A virus
  misc_feature (1)..(560): AJJ91314 A/chicken/Shaoxing/2417/2013 2013/10/20 HA 755179470
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPPVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 129 - protein, 560 aa, Influenza A virus
  misc_feature (1)..(560): AJJ91402 A/chicken/Huzhou/4045/2013 2013/10/24 HA 755179618
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKEVILWFSFGASCFILLAIVMGLVFICVKNGNMRCTICI

SEQ ID NO: 130 - protein, 560 aa, Influenza A virus
  misc_feature (1)..(560): AJJ91476 A/chicken/Huzhou/4076/2013 2013/10/24 HA 755179743
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 131 - protein, 560 aa, Influenza A virus
  misc_feature (1)..(560): AJJ91725 A/chicken/Shaoxing/5201/2013 2013/10/28 HA 755180161
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 132 - protein, 560 aa, Influenza A virus
  misc_feature (1)..(560): AJJ91885 A/Shenzhen/SP4/2014 2014/01/16 HA 755180429
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSRGYKDVILWFSFGASCFILLAIVMGLVFICVKNGNMRCTICI

SEQ ID NO: 133 - protein, 560 aa, Influenza A virus
  misc_feature (1)..(560): AJJ91909 A/Shenzhen/SP26/2014 2014/01/20 HA 755180469
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACKRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDGCMASIRNNTYDHSKYREEAMQNRIQIDPVKLSRGYKDVILWFSFGASCFILLAIVMGLVFICVKNGNMRCTICI

SEQ ID NO: 134 - protein, 560 aa, Influenza A virus
  misc_feature (1)..(560): AJJ91945 A/Shenzhen/SP38/2014 2014/01/22 HA 755180529
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIGGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 135 - protein, 560 aa, Influenza A virus
  misc_feature (1)..(560): AJJ91957 A/Shenzhen/SP44/2014 2014/01/23 HA 755180549
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGTTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISSLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 136 - protein, 560 aa, Influenza A virus
  misc_feature (1)..(560): AJJ91969 A/Shenzhen/SP48/2014 2014/01/23 HA 755180569
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 137 - protein, 560 aa, Influenza A virus
  misc_feature (1)..(560): AJJ91993 A/chicken/Dongguan/4119/2013 2013/12/19 HA 755180609
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLLGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFTLLAIVMGLVFICVKNGNMRCTICI

SEQ ID NO: 138 - protein, 560 aa, Influenza A virus
  misc_feature (1)..(560): AJJ92031 A/chicken/Dongguan/4064/2013 2013/12/19 HA 755180672
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVESSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 139 - protein, 560 aa, Influenza A virus
  misc_feature (1)..(560): AJJ92967 A/silkie chicken/Jiangxi/9469/2014 2014/02/16 HA 755182232
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 140 - protein, 560 aa, Influenza A virus
  misc_feature (1)..(560): AJJ93027 A/chicken/Jiangxi/9558/2014 2014/02/16 HA 755182332
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVKEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 141 - protein, 560 aa, Influenza A virus
  misc_feature (1)..(560): AJJ93051 A/chicken/Jiangxi/10573/2014 2014/02/18 HA 755182372
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 142 - protein, 560 aa, Influenza A virus
  misc_feature (1)..(560): AJJ93845 A/silkie chicken/Dongguan/157/2014 2014/02/20 HA 755183695
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 143 - protein, 560 aa, Influenza A virus
  misc_feature (1)..(560): AJJ93857 A/chicken/Dongguan/169/2014 2014/02/20 HA 755183715
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACMRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 144 - protein, 560 aa, Influenza A virus
  misc_feature (1)..(560): AJJ93869 A/chicken/Dongguan/173/2014 2014/02/20 HA 755183735
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 145 - protein, 560 aa, Influenza A virus
  misc_feature (1)..(560): AJJ93881 A/chicken/Dongguan/189/2014 2014/02/20 HA 755183755
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPKYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 146 - protein, 560 aa, Influenza A virus
  misc_feature (1)..(560): AJJ93907 A/chicken/Dongguan/449/2014 2014/02/20 HA 755183799
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 147 - protein, 560 aa, Influenza A virus
  misc_feature (1)..(560): AJJ93931 A/chicken/Dongguan/536/2014 2014/02/20 HA 755183839
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISKLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 148 - protein, 560 aa, Influenza A virus
  misc_feature (1)..(560): AJJ93943 A/chicken/Dongguan/568/2014 2014/02/20 HA 755183859
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 149 - protein, 560 aa, Influenza A virus
  misc_feature (1)..(560): AJJ93979 A/silkie chicken/Dongguan/656/2014 2014/02/20 HA 755183919
MNTQILVFALIAIIPTNADKICLGHHAVSNGTKVNTLTERGVEVVNATETVERTNIPRICSKGKKTVDLGQCGLLGTVTGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFGLIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 150 - protein, 560 aa, Influenza A virus
  misc_feature (1)..(560): AJJ94134 A/chicken/Dongguan/1051/2014 2014/02/21 HA 755184182
  misc_feature (516)..(516): Xaa can be any naturally occurring amino acid
  misc_feature (519)..(519): Xaa can be any naturally occurring amino acid
MNTQILVLALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVXLSXGYKDVILWFSFGASCFILLAIVMGLVFICVKNGNMRCTICI

SEQ ID NO: 151 - protein, 560 aa, Influenza A virus
  misc_feature (1)..(560): AJJ94158 A/chicken/Dongguan/1075/2014 2014/02/21 HA 755184222
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFILLAIVMGLVFICVKNGNMRCTICI

SEQ ID NO: 152 - protein, 560 aa, Influenza A virus
  misc_feature (1)..(560): AJJ94182 A/chicken/Dongguan/1177/2014 2014/02/21 HA 755184262
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACKRSGSSFYAEMKWLLSNTDNAAFPQMTKSYKNTRKSPALIVWGIHHSVSIAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 153 - protein, 560 aa, Influenza A virus
  misc_feature (1)..(560): AJJ94194 A/silkie chicken/Dongguan/1264/2014 2014/02/21 HA 755184282
MNTQILVFALIAIIPTNADKICLGHHAVSNGTKVNTLTERGVEVVNATETVERTNIPRICSKGKKTIDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQVTGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 154 - protein, 560 aa, Influenza A virus
  misc_feature (1)..(560): AJJ94206 A/silkie chicken/Dongguan/1268/2014 2014/02/21 HA 755184302
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISDLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 155 - protein, 560 aa, Influenza A virus
  misc_feature (1)..(560): AJJ94344 A/silkie chicken/Dongguan/1451/2014 2014/02/21 HA 755184532
MNTQILVFALIAIIPTNADKICLGHHAVSNGTKVNTLTERGVEVVNSTETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRTVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 156 - protein, 560 aa, Influenza A virus
  misc_feature (1)..(560): AJJ94356 A/chicken/Dongguan/1456/2014 2014/02/21 HA 755184552
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 157 - protein, 560 aa, Influenza A virus
  misc_feature (1)..(560): AJJ94396 A/chicken/Dongguan/1494/2014 2014/02/21 HA 755184618
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPETPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 158 - protein, 560 aa, Influenza A virus
  misc_feature (1)..(560): AJJ94754 A/chicken/Dongguan/748/2014 2014/02/20 HA 755185215
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSNAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 159 - protein, 560 aa, Influenza A virus
  misc_feature (1)..(560): AJJ94838 A/chicken/Dongguan/835/2014 2014/02/20 HA 755185356
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSASTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFGFGASCFILLAIVMGLVFICVKNGNMRCTICI

SEQ ID NO: 160 - protein, 560 aa, Influenza A virus
  misc_feature (1)..(560): AJJ94862 A/chicken/Dongguan/843/2014 2014/02/20 HA 755185396
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIEKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 161 - protein, 560 aa, Influenza A virus
  misc_feature (1)..(560): AJJ94886 A/chicken/Dongguan/851/2014 2014/02/20 HA 755185436
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 162 - protein, 560 aa, Influenza A virus
  misc_feature (1)..(560): AJJ94910 A/chicken/Dongguan/874/2014 2014/02/20 HA 755185476
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSASTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 163 - protein, 560 aa, Influenza A virus
  misc_feature (1)..(560): AJJ94959 A/silkie chicken/Dongguan/967/2014 2014/02/21 HA 755185558
  misc_feature (148)..(148): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACXRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 164 - protein, 560 aa, Influenza A virus
  misc_feature (1)..(560): AJJ95048 A/chicken/Dongguan/1009/2014 2014/02/21 HA 755185708
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPETPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDNDCMASIRNNTYDHSKYREEAMQNRIQIDPVKLSSGYKDVILWFSFGASCFILLAIVMGLVFICVKNGNMRCTICI

SEQ ID NO: 165 - protein, 560 aa, Influenza A virus
  misc_feature (1)..(560): AJJ95171 A/chicken/Dongguan/1314/2014 2014/02/21 HA 755185913
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFNFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 166 - protein, 560 aa, Influenza A virus
  misc_feature (1)..(560): AJJ95227 A/chicken/Dongguan/1382/2014 2014/02/21 HA 755186006
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDICYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 167 - protein, 560 aa, Influenza A virus
  misc_feature (1)..(560): AJJ95251 A/chicken/Dongguan/1401/2014 2014/02/21 HA 755186046
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYKRVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 168 - protein, 560 aa, Influenza A virus
  misc_feature (1)..(560): AJJ95346 A/chicken/Dongguan/1548/2014 2014/02/21 HA 755186206
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYKRVKRQLRENAEEDGTGCFEIFHKCDDDCMASIRNNTYDHNKYREEAMQNRIQIDPVKLSSGYKDVILWFSFGASCFILLAIVMGLVFICVKNGNMRCTICI

SEQ ID NO: 169 - protein, 560 aa, Influenza A virus
  misc_feature (1)..(560): AJJ95382 A/chicken/Dongguan/1690/2014 2014/02/21 HA 755186266
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 170 - protein, 560 aa, Influenza A virus
  misc_feature (1)..(560): AJJ95464 A/chicken/Shenzhen/138/2014 2014/02/19 HA 755186404
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 171 - protein, 560 aa, Influenza A virus
  misc_feature (1)..(560): AJJ95572 A/chicken/Dongguan/1100/2014 2014/02/21 HA 755186584
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIEKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSGGYKDVILWFSFGASCFILLAIVMGLVFICVKNGNMRCTICI

SEQ ID NO: 172 - protein, 560 aa, Influenza A virus
  misc_feature (1)..(560): AJJ95584 A/silkie chicken/Dongguan/1519/2014 2014/02/21 HA 755186604
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPERASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYRGEAMQNRIQIDPVKLSSGYKDVILWFSFGASCFMLLAIVMGLVFICVKNGNMRCTICI

SEQ ID NO: 173 - protein, 560 aa, Influenza A virus
  misc_feature (1)..(560): AJJ95596 A/Shenzhen/SP58/2014 2014/01/25 HA 755186624
MNTQILAFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRANGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 174 - protein, 560 aa, Influenza A virus
  misc_feature (1)..(560): AJJ95620 A/Shenzhen/SP75/2014 2014/02/15 HA 755186664
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGSTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAVVMGLVFICVKNGNMRCTICI

SEQ ID NO: 175 - protein, 560 aa, Influenza A virus
  misc_feature (1)..(560): AJJ95632 A/Shenzhen/SP62/2014 2014/02/05 HA 755186684
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNATFPQMTKSYKNTRKSPALIIWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVETQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 176 - protein, 560 aa, Influenza A virus
  misc_feature (1)..(560): AJJ96720 A/chicken/Jiangxi/13220/2014 2014/03/30 HA 755188499
MNTQILVFALIAIIPTNADKICLGHHAVSNGTKVNTLTERGVEVVNATETVERTTIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 177 - protein, 560 aa, Influenza A virus
  misc_feature (1)..(560): AJJ96817 A/chicken/Jiangxi/9513/2014 2014/02/16 HA 755188661
MNTQILVFALIAIVPTNADKICLGHHAVSNGTKVNTLTERGVEVVNATEIVERTNIPRICSKGKKTVDLGQCGLLGTITGPPQCDQFLEFSADLIIERREGSDVCYPGKFVNEEALRQILRESGGIDKEAMGFTYSGIRTNGVTSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 178 - protein, 560 aa, Influenza A virus
  misc_feature (1)..(560): AJJ96841 A/Shenzhen/SP139/2014 2014/04/02 HA 755188701
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSTCRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRACFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVERQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 179 - protein, 560 aa, Influenza A virus
  misc_feature (1)..(560): AJJ96889 A/chicken/Jiangxi/13496/2014 2014/04/11 HA 755188781
  misc_feature (55)..(55): Xaa can be any naturally occurring amino acid
  misc_feature (129)..(129): Xaa can be any naturally occurring amino acid
  misc_feature (294)..(294): Xaa can be any naturally occurring amino acid
MNTQILVFALIAIIPTNADKICLGHHAVSNGTKVNTLTERGVEVVNATETVERTXIPRICSKGKKTVDLGQCGLLGTITGPPQCDQFLEFSADLIIERREGSDVCYPGKFVNEEALRQILRESGGIDKXAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSXGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 180 - protein, 560 aa, Influenza A virus
  misc_feature (1)..(560): AJJ96901 A/chicken/Jiangxi/13502/2014 2014/04/11 HA 755188801
  misc_feature (294)..(294): Xaa can be any naturally occurring amino acid
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSXGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 181 - protein, 560 aa, Influenza A virus
  misc_feature (1)..(560): AJJ96925 A/chicken/Jiangxi/13513/2014 2014/04/11 HA 755188841
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHTVSTAEQTKLYGSGNKLVTVGSSNYQQSFVPSPGARPQVNGLSGRIDLHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 182 - protein, 560 aa, Influenza A virus
  misc_feature (1)..(560): AJJ97267 A/chicken/Jiangxi/13252/2014 2014/03/30 HA 755189411
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 183 - protein, 560 aa, Influenza A virus
  misc_feature (1)..(560): AJJ97291 A/chicken/Jiangxi/13493/2014 2014/04/06 HA 755189451
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 184 - protein, 560 aa, Influenza A virus
  misc_feature (1)..(560): AJJ97331 A/chicken/Jiangxi/13512/2014 2014/04/06 HA 755189517
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSIGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 185 - protein, 560 aa, Influenza A virus
  misc_feature (1)..(560): AJJ97373 A/chicken/Jiangxi/13521/2014 2014/04/06 HA 755189587
  misc_feature (264)..(264): Xaa can be any naturally occurring amino acid
  misc_feature (274)..(274): Xaa can be any naturally occurring amino acid
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPXRASFLRGKSXGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 186 - protein, 560 aa, Influenza A virus
  misc_feature (1)..(560): AJJ97443 A/chicken/Jiangxi/13530/2014 2014/04/06 HA 755189702
MNTQILVFALIAIIPTNADKICLGHHAVSNGTKVNTLTERGVEVVNATETVERTTIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSRGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 187 - protein, 560 aa, Influenza A virus
  misc_feature (1)..(560): AJJ97582 A/chicken/Jiangxi/14023/2014 2014/04/13 HA 755189933
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 188 - protein, 560 aa, Influenza A virus
  misc_feature (1)..(560): AJJ97697 A/chicken/Jiangxi/14517/2014 2014/04/20 HA 755190125
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCDGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 189 - protein, 560 aa, Influenza A virus
  misc_feature (1)..(560): AJJ97709 A/chicken/Jiangxi/14518/2014 2014/04/20 HA 755190145
MNTQILVFALIAIIPANADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYNGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGNCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFICVKNGNMRCTICI

SEQ ID NO: 190 - protein, 560 aa, Influenza A virus
  misc_feature (1)..(560): AJJ97745 A/chicken/Jiangxi/14554/2014 2014/04/20 HA 755190205
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELMDNEFNEVEKQIGNVINWTRDSITELWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 191 - protein, 560 aa, Influenza A virus
  misc_feature (1)..(560): AJJ97757 A/chicken/Shantou/2537/2014 2014/04/16 HA 755190225
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEIPKGRGLFGAIAGFIENGWEGLIDGWYGFKHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 192 - protein, 560 aa, Influenza A virus
  misc_feature (1)..(560): AJJ97841 A/duck/Jiangxi/15044/2014 2014/04/27 HA 755190365
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVRLSSGYKDVILWFSFGASCFILLAIVMGLVFICVKNGNMRCTICI

SEQ ID NO: 193 - protein, 560 aa, Influenza A virus
  misc_feature (1)..(560): AJJ97899 A/chicken/Jiangxi/15524/2014 2014/05/05 HA 755190462
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIAKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHRKYREEAMQNRIQIDPVKLSSGYKDVILWFSFGASCFILLAIVMGLVFMCVKNGNMRCTICI

SEQ ID NO: 194 - protein, 560 aa, Influenza A virus
  misc_feature (1)..(560): AJJ97925 A/silkie chicken/Shantou/2050/2014 2014/03/25 HA 755190506
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGATSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEVPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 195 - protein, 560 aa, Influenza A virus
  misc_feature (1)..(560): AJJ97973 A/chicken/Shantou/4325/2014 2014/07/01 HA 755190586
MNTQILVFALISIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRKSGGIDKEAMGFTYSGIRTNGVTSACRRSGSSFYAEMKWLLSNTDNAAFPQMTKSYKNTRKSPAIIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDADCEGDCYHSGGTIISNLPFQNIDSRAVGKCPRYVKQRSLLLATGMKNVPEVPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 196 - protein, 560 aa, Influenza A virus
  misc_feature (1)..(560): AJJ97998 A/chicken/Shantou/4816/2014 2014/07/22 HA 755190628
MNTQILVFALIAIVPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQKSLLLATGMKNVPEIPKGRGLFGAIAGFIENGWEGLIDGWYGFRHQNAQGEGTAADYKSTQSAIDQITGKLNRLIEKTNQQFELVDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 197 - protein, 349 aa, Influenza A virus; identical to SEQ ID NO: 1
  misc_feature (1)..(349): AAM19228 A/turkey/Minnesota/38429/1988 1988// HA 20335017

SEQ ID NO: 198 - protein, 560 aa, Influenza A virus; identical to SEQ ID NO: 2
  misc_feature (1)..(560): AAY46211 A/mallard/Sweden/91/2002 2002// HA 66394828

SEQ ID NO: 199 - protein, 560 aa, Influenza A virus; identical to SEQ ID NO: 3
  misc_feature (1)..(560): ABI84694 A/turkey/Minnesota/1/1988 1988/07/13 HA 115278573

SEQ ID NO: 200 - protein, 560 aa, Influenza A virus; identical to SEQ ID NO: 4
  misc_feature (1)..(560): ABS89409 A/blue-winged teal/Ohio/566/2006 2006// HA 155016324

SEQ ID NO: 201 - protein, 560 aa, Influenza A virus; identical to SEQ ID NO: 5
  misc_feature (1)..(560): ACD03594 A/ruddy turnstone/DE/1538/2000 2000// HA 187384848

SEQ ID NO: 202 - protein, 560 aa, Influenza A virus; identical to SEQ ID NO: 6
  misc_feature (1)..(560): BAH22785 A/duck/Mongolia/119/2008 2008// HA 223717820

SEQ ID NO: 203 - protein, 560 aa, Influenza A virus; identical to SEQ ID NO: 7
  misc_feature (1)..(560): CAY39406 A/Anas crecca/Spain/1460/2008 2008/01/26 HA 254674376

SEQ ID NO: 204 - protein, 560 aa, Influenza A virus; identical to SEQ ID NO: 8
  misc_feature (1)..(560): ACX53683 A/goose/Czech Republic/1848-K9/2009 2009/02/04 HA 260907763

SEQ ID NO: 205 - protein, 404 aa, Influenza A virus; identical to SEQ ID NO: 9
  misc_feature (1)..(404): ACZ48625 A/turkey/Minnesota/38429/1988 1988// HA 269826341

SEQ ID NO: 206 - protein, 160 aa, Influenza A virus; identical to SEQ ID NO: 10
  misc_feature (1)..(160): ADC29485 A/mallard/Spain/08.00991.3/2005 2005/11/ HA 284927336

SEQ ID NO: 207 - protein, 560 aa, Influenza A virus; identical to SEQ ID NO: 11
  misc_feature (1)..(560): ADK71137 A/blue-winged teal/Guatemala/CIP049-01/2008 2008/02/07 HA 301333785

SEQ ID NO: 208 - protein, 560 aa, Influenza A virus; identical to SEQ ID NO: 12
  misc_feature (1)..(560): ADK71148 A/blue-winged teal/Guatemala/CIP049-02/2008 2008/03/05 HA 301333804
  misc_feature (47)..(47): Xaa can be any naturally occurring amino acid

SEQ ID NO: 209 - protein, 560 aa, Influenza A virus; identical to SEQ ID NO: 13
  misc_feature (1)..(560): ADN34727 A/goose/Czech Republic/1848-T14/2009 2009/02/04 HA 307141869
  misc_feature (143)..(143): Xaa can be any naturally occurring amino acid

SEQ ID NO: 210 - protein, 303 aa, Influenza A virus; identical to SEQ ID NO: 14
  misc_feature (1)..(303): AEK84760 A/wild bird/Korea/A14/2011 2011/02/ HA 341610308

SEQ ID NO: 211 - protein, 556 aa, Influenza A virus; identical to SEQ ID NO: 15
  misc_feature (1)..(556): AEK84761 A/wild bird/Korea/A3/2011 2011/02/ HA 341610310

SEQ ID NO: 212 - protein, 556 aa, Influenza A virus; identical to SEQ ID NO: 16
  misc_feature (1)..(556): AEK84763 A/wild bird/Korea/A9/2011 2011/02/ HA 341610314

SEQ ID NO: 213 - protein, 555 aa, Influenza A virus; identical to SEQ ID NO: 17
  misc_feature (1)..(555): AEK84765 A/spot-billed duck/Korea/447/2011 2011/04/ HA 341610318

SEQ ID NO: 214 - protein, 555 aa, Influenza A virus; identical to SEQ ID NO: 18
  misc_feature (1)..(555): AEM98291 A/wild duck/Mongolia/1-241/2008 2008/04/ HA 344196120

SEQ ID NO: 215 - protein, 557 aa, Influenza A virus; identical to SEQ ID NO: 19
  misc_feature (1)..(557): AFM09439 A/emperor goose/Alaska/44063-061/2006 2006/05/23 HA 390535062

SEQ ID NO: 216 - protein, 560 aa, Influenza A virus; identical to SEQ ID NO: 20
  misc_feature (1)..(560): AFV33945 A/guinea fowl/Nebraska/17096-1/2011 2011/04/05 HA 409676820

SEQ ID NO: 217 - protein, 560 aa, Influenza A virus; identical to SEQ ID NO: 21
  misc_feature (1)..(560): AFV33947 A/goose/Nebraska/17097-4/2011 2011/04/05 HA 409676827

SEQ ID NO: 218 - protein, 560 aa, Influenza A virus; identical to SEQ ID NO: 22
  misc_feature (1)..(560): AFX85260 A/ruddy turnstone/Delaware Bay/220/1995 1995/05/21 HA 423514912

SEQ ID NO: 219 - protein, 560 aa, Influenza A virus; identical to SEQ ID NO: 23
  misc_feature (1)..(560): AGE08098 A/northern shoverl/Mississippi/11OS145/2011 2011/01/08 HA 444344488

SEQ ID NO: 220 - protein, 560 aa, Influenza A virus; identical to SEQ ID NO: 24
  misc_feature (1)..(560): AGI60301 A/Hangzhou/1/2013 2013/03/24 HA 475662454

SEQ ID NO: 221 - protein, 560 aa, Influenza A virus; identical to SEQ ID NO: 25
  misc_feature (1)..(560): AGI60292 A/Shanghai/4664T/2013 2013/03/05 HA 476403560

SEQ ID NO: 222 - protein, 560 aa, Influenza A virus; identical to SEQ ID NO: 26
  misc_feature (1)..(560): AGJ72861 A/chicken/Zhejiang/DTID-ZJU01/2013 2013/04/ HA 479280294

SEQ ID NO: 223 - protein, 560 aa, Influenza A virus; identical to SEQ ID NO: 27
  misc_feature (1)..(560): AGJ73503 A/Nanjing/1/2013 2013/03/28 HA 479285761

SEQ ID NO: 224 - protein, 560 aa, Influenza A virus; identical to SEQ ID NO: 28
  misc_feature (1)..(560): BAN16711 A/duck/Gunma/466/2011 2011// HA 482661571

SEQ ID NO: 225 - protein, 560 aa, Influenza A virus; identical to SEQ ID NO: 29
  misc_feature (1)..(560): AGK84857 A/Hangzhou/2/2013 2013/04/01 HA 485649824

SEQ ID NO: 226 - protein, 560 aa, Influenza A virus; identical to SEQ ID NO: 30
  misc_feature (1)..(560): AGL44438 A/Shanghai/02/2013 2013/03/05 HA 496493389

SEQ ID NO: 227 - protein, 206 aa, Influenza A virus; identical to SEQ ID NO: 31
  misc_feature (1)..(206): AGL33692 A/Shanghai/4655T/2013 2013/02/26 HA 491874175

SEQ ID NO: 228 - protein, 206 aa, Influenza A virus; identical to SEQ ID NO: 32
  misc_feature (1)..(206): AGL33693 A/Shanghai/4659T/2013 2013/02/27 HA 491874186

SEQ ID NO: 229 - protein, 549 aa, Influenza A virus; identical to SEQ ID NO: 33
  misc_feature (1)..(549): AGL95088 A/Taiwan/S02076/2013 2013/04/22 HA 501485301

SEQ ID NO: 230 - protein, 552 aa, Influenza A virus; identical to SEQ ID NO: 34
  misc_feature (1)..(552): AGL95098 A/Taiwan/T02081/2013 2013/04/22 HA 501485319

SEQ ID NO: 231 - protein, 196 aa, Influenza A virus; identical to SEQ ID NO: 35
  misc_feature (1)..(196): AGM53883 A/Shanghai/5083T/2013 2013/04/20 HA 507593986

SEQ ID NO: 232 - protein, 193 aa, Influenza A virus; identical to SEQ ID NO: 36
  misc_feature (1)..(193): AGM53884 A/Shanghai/5180T/2013 2013/04/23 HA 507593988

SEQ ID NO: 233 - protein, 192 aa, Influenza A virus; identical to SEQ ID NO: 37
  misc_feature (1)..(192): AGM53885 A/Shanghai/5240T/2013 2013/04/25 HA 507593990

SEQ ID NO: 234 - protein, 191 aa, Influenza A virus; identical to SEQ ID NO: 38
  misc_feature (1)..(191): AGM53886 A/Shanghai/4842T/2013 2013/04/13 HA 507593992

SEQ ID NO: 235 - protein, 193 aa, Influenza A virus; identical to SEQ ID NO: 39
  misc_feature (1)..(193): AGM53887 A/Shanghai/4701T/2013 2013/04/06 HA 507593994

SEQ ID NO: 236 - protein, 560 aa, Influenza A virus; identical to SEQ ID NO: 40
  misc_feature (1)..(560): AGN69462 A/Wuxi/2/2013 2013/03/31 HA 511105778

SEQ ID NO: 237 - protein, 560 aa, Influenza A virus; identical to SEQ ID NO: 41
  misc_feature (1)..(560): AGN69474 A/Wuxi/1/2013 2013/03/31 HA 511105798

SEQ ID NO: 238 - protein, 560 aa, Influenza A virus; identical to SEQ ID NO: 42
  misc_feature (1)..(560): AGO51387 A/Jiangsu/2/2013 2013/04/20 HA 514390990
  misc_feature (503)..(503): Xaa can be any naturally occurring amino acid
  misc_feature (507)..(507): Xaa can be any naturally occurring amino acid
  misc_feature (508)..(508): Xaa is Asn or Asp
  misc_feature (509)..(509): Xaa can be any naturally occurring amino acid
  misc_feature (525)..(525): Xaa can be any naturally occurring amino acid
  misc_feature (526)..(526): Xaa is Ile or Leu

SEQ ID NO: 239 - protein, 560 aa, Influenza A virus; identical to SEQ ID NO: 43
  misc_feature (1)..(560): BAN59726 A/duck/Mongolia/147/2008 2008/08/29 HA 519661951

SEQ ID NO: 240 - protein, 560 aa, Influenza A virus; identical to SEQ ID NO: 44
  misc_feature (1)..(560): BAN59727 A/duck/Mongolia/129/2010 2010// HA 519661954

SEQ ID NO: 241 - protein, 560 aa, Influenza A virus; identical to SEQ ID NO: 45
  misc_feature (1)..(560): AGQ80952 A/duck/Jiangxi/3096/2009 2009// HA 523788794

SEQ ID NO: 242 - protein, 560 aa, Influenza A virus; identical to SEQ ID NO: 46
  misc_feature (1)..(560): AGQ80989 A/duck/Jiangxi/3257/2009 2009// HA 523788868
  misc_feature (215)..(215): Xaa can be any naturally occurring amino acid

SEQ ID NO: 243 - protein, 560 aa, Influenza A virus; identical to SEQ ID NO: 47
  misc_feature (1)..(560): AGQ81043 A/chicken/Rizhao/515/2013 2013// HA 523788976

SEQ ID NO: 244 - protein, 560 aa, Influenza A virus; identical to SEQ ID NO: 48
  misc_feature (1)..(560): AGR33894 A/chicken/Rizhao/719b/2013 2013// HA 524845213
  misc_feature (510)..(521): Xaa can be any naturally occurring amino acid

SEQ ID NO: 245 - protein, 560 aa, Influenza A virus; identical to SEQ ID NO: 49
  misc_feature (1)..(560): AGR49399 A/chicken/Jiangxi/SD001/2013 2013/05/03 HA 525338528

SEQ ID NO: 246 - protein, 560 aa, Influenza A virus; identical to SEQ ID NO: 50
  misc_feature (1)..(560): AGR49495 A/chicken/Shanghai/S1358/2013 2013/04/03 HA 525338689

SEQ ID NO: 247 - protein, 560 aa, Influenza A virus; identical to SEQ ID NO: 51
  misc_feature (1)..(560): AGR49506 A/chicken/Shanghai/S1410/2013 2013/04/03 HA 525338708

SEQ ID NO: 248 - protein, 560 aa, Influenza A virus; identical to SEQ ID NO: 52
  misc_feature (1)..(560): AGR49554 A/chicken/Zhejiang/SD033/2013 2013/04/11 HA 525338789

SEQ ID NO: 249 - protein, 560 aa, Influenza A virus; identical to SEQ ID NO: 53
  misc_feature (1)..(560): AGR49566 A/duck/Anhui/SC702/2013 2013/04/16 HA 525338809

SEQ ID NO: 250 - protein, 560 aa, Influenza A virus; identical to SEQ ID NO: 54
  misc_feature (1)..(560): AGR49722 A/homing pigeon/Jiangsu/SD184/2013 2013/04/20 HA 525339071

SEQ ID NO: 251 - protein, 560 aa, Influenza A virus; identical to SEQ ID NO: 55
  misc_feature (1)..(560): AGR49734 A/pigeon/Shanghai/S1069/2013 2013/04/02 HA 525339091

SEQ ID NO: 252 - protein, 560 aa, Influenza A virus; identical to SEQ ID NO: 56
  misc_feature (1)..(560): AGR49770 A/wild pigeon/Jiangsu/SD001/2013 2013/04/17 HA 525339151

SEQ ID NO: 253 - protein, 560 aa, Influenza A virus; identical to SEQ ID NO: 57
  misc_feature (1)..(560): AGY41893 A/Huizhou/01/2013 2013/08/08 HA 552049496

SEQ ID NO: 254 - protein, 553 aa, Influenza A virus; identical to SEQ ID NO: 58
  misc_feature (1)..(553): AGY42258 A/mallard/Sweden/91/2002 2002/12/12 HA 552052155
  misc_feature (72)..(72): Xaa can be any naturally occurring amino acid
  misc_feature (137)..(137): Xaa can be any naturally occurring amino acid

SEQ ID NO: 255 - protein, 560 aa, Influenza A virus; identical to SEQ ID NO: 59
  misc_feature (1)..(560): AHA11441 A/guinea fowl/Nebraska/17096/2011 2011/04/10 HA 557478572

SEQ ID NO: 256 - protein, 560 aa, Influenza A virus; identical to SEQ ID NO: 60
  misc_feature (1)..(560): AHA11452 A/turkey/Minnesota/32710/2011 2011/07/12 HA 557478591

SEQ ID NO: 257 - protein, 560 aa, Influenza A virus; identical to SEQ ID NO: 61
  misc_feature (1)..(560): AHA11461 A/turkey/Minnesota/31900/2011 2011/07/05 HA 557478606

SEQ ID NO: 258 - protein, 560 aa, Influenza A virus; identical to SEQ ID NO: 62
  misc_feature (1)..(560): AHK10585 A/chicken/Guangdong/G1/2013 2013/05/05 HA 587680636

SEQ ID NO: 259 - protein, 560 aa, Influenza A virus; identical to SEQ ID NO: 63
  misc_feature (1)..(560): AGG53366 A/wild duck/Korea/CSM42-34/2011 2011/03/ HA 459252887

SEQ ID NO: 260 - protein, 557 aa, Influenza A virus; identical to SEQ ID NO: 64
  misc_feature (1)..(557): AGG53377 A/wild duck/Korea/CSM42-1/2011 2011/03/ HA 459252925

SEQ ID NO: 261 - protein, 560 aa, Influenza A virus; identical to SEQ ID NO: 65
  misc_feature (1)..(560): AGG53399 A/wild duck/Korea/MHC39-26/2011 2011/03/ HA 459253005

SEQ ID NO: 262 - protein, 557 aa, Influenza A virus; identical to SEQ ID NO: 66
  misc_feature (1)..(557): AGG53432 A/wild duck/Korea/MHC35-41/2011 2011/03/ HA 459253136

SEQ ID NO: 263 - protein, 558 aa, Influenza A virus; identical to SEQ ID NO: 67
  misc_feature (1)..(558): AGG53476 A/wild duck/Korea/SH19-27/2010 2010/12/ HA 459253257

SEQ ID NO: 264 - protein, 560 aa, Influenza A virus; identical to SEQ ID NO: 68
  misc_feature (1)..(560): AGG53487 A/wild duck/Korea/SH19-50/2010 2010/01/ HA 459253278

SEQ ID NO: 265 - protein, 552 aa, Influenza A virus; identical to SEQ ID NO: 69
  misc_feature (1)..(552): AGG53520 A/wild duck/Korea/SH20-27/2008 2008/12/ HA 459253409

SEQ ID NO: 266 - protein, 560 aa, Influenza A virus; identical to SEQ ID NO: 70
  misc_feature (1)..(560): AGL43637 A/Taiwan/1/2013 2013// HA 496297389

SEQ ID NO: 267 - protein, 510 aa, Influenza A virus; identical to SEQ ID NO: 71
  misc_feature (1)..(510): AGL97639 A/mallard/Minnesota/AI09-3770/2009 2009/09/12 HA 505555371

SEQ ID NO: 268 - protein, 560 aa, Influenza A virus; identical to SEQ ID NO: 72
  misc_feature (1)..(560): AGO02477 A/Xuzhou/1/2013 2013/04/25 HA 512403688

SEQ ID NO: 269 - protein, 560 aa, Influenza A virus; identical to SEQ ID NO: 73
  misc_feature (1)..(560): AGR84942 A/Suzhou/5/2013 2013/04/12 HA 526304561

SEQ ID NO: 270 - protein, 560 aa, Influenza A virus; identical to SEQ ID NO: 74
  misc_feature (1)..(560): AGR84954 A/Nanjing/6/2013 2013/04/11 HA 526304594

SEQ ID NO: 271 - protein, 560 aa, Influenza A virus; identical to SEQ ID NO: 75
  misc_feature (1)..(560): AGR84978 A/Wuxi/4/2013 2013/04/07 HA 526304656

SEQ ID NO: 272 - protein, 560 aa, Influenza A virus; identical to SEQ ID NO: 76
  misc_feature (1)..(560): AGR84990 A/Wuxi/3/2013 2013/04/07 HA 526304688

SEQ ID NO: 273 - protein, 560 aa, Influenza A virus; identical to SEQ ID NO: 77
  misc_feature (1)..(560): AGR85002 A/Zhenjiang/1/2013 2013/04/07 HA 526304708

SEQ ID NO: 274 - protein, 560 aa, Influenza A virus; identical to SEQ ID NO: 78
  misc_feature (1)..(560): AGR85026 A/Nanjing/2/2013 2013/04/05 HA 526304762

SEQ ID NO: 275 - protein, 552 aa, Influenza A virus; identical to SEQ ID NO: 79
  misc_feature (1)..(552): AGU02230 A/Zhejiang/DTID-ZJU05/2013 2013/04/ HA 532808765

SEQ ID NO: 276 - protein, 550 aa, Influenza A virus; identical to SEQ ID NO: 80
  misc_feature (1)..(550): AGU02233 A/Zhejiang/DTID-ZJU08/2013 2013/04/ HA 532808788

SEQ ID NO: 277 - protein, 560 aa, Influenza A virus; identical to SEQ ID NO: 81
  misc_feature (1)..(560): AGW82588 A/tree sparrow/Shanghai/01/2013 2013/05/09 HA 546235348

SEQ ID NO: 278 - protein, 552 aa, Influenza A virus; identical to SEQ ID NO: 82
  misc_feature (1)..(552): AGW82600 A/Shanghai/CN01/2013 2013/04/11 HA 546235368

SEQ ID NO: 279 - protein, 560 aa, Influenza A virus; identical to SEQ ID NO: 83
  misc_feature (1)..(560): AGW82612 A/Shanghai/JS01/2013 2013/04/03 HA 546235388

SEQ ID NO: 280 - protein, 560 aa, Influenza A virus; identical to SEQ ID NO: 84
  misc_feature (1)..(560): AHA11472 A/turkey/Minnesota/31676/2009 2009/12/08 HA 557478625

SEQ ID NO: 281 - protein, 560 aa, Influenza A virus; identical to SEQ ID NO: 85
  misc_feature (1)..(560): AHA11483 A/turkey/Minnesota/14135-2/2009 2009/08/07 HA 557478644

SEQ ID NO: 282 - protein, 549 aa, Influenza A virus; identical to SEQ ID NO: 86
  misc_feature (1)..(549): AHA11500 A/Zhejiang/DTID-ZJU10/2013 2013/10/14 HA 557478676

SEQ ID NO: 283 - protein, 560 aa, Influenza A virus; identical to SEQ ID NO: 87
  misc_feature (1)..(560): AHA57050 A/turkey/Minnesota/14659/2009 2009/08/12 HA 558484427

SEQ ID NO: 284 - protein, 560 aa, Influenza A virus; identical to SEQ ID NO: 88
  misc_feature (1)..(560): AHA57072 A/turkey/Minnesota/18421/2009 2009/09/09 HA 558484465

SEQ ID NO: 285 - protein, 554 aa, Influenza A virus; identical to SEQ ID NO: 89
  misc_feature (1)..(554): AHD25003 A/Guangdong/02/2013 2013/10/ HA 568260567

SEQ ID NO: 286 - protein, 560 aa, Influenza A virus; identical to SEQ ID NO: 90
  misc_feature (1)..(560): AHF20528 A/Hong Kong/470129/2013 2013/11/30 HA 570933555

SEQ ID NO: 287 - protein, 560 aa, Influenza A virus; identical to SEQ ID NO: 91
  misc_feature (1)..(560): AHF20568 A/Shanghai/CN02/2013 2013/04/02 HA 570933626

SEQ ID NO: 288 - protein, 560 aa, Influenza A virus; identical to SEQ ID NO: 92
  misc_feature (1)..(560): AHH25185 A/Guangdong/04/2013 2013/12/16 HA 576106234

SEQ ID NO: 289 - protein, 560 aa, Influenza A virus; identical to SEQ ID NO: 93
  misc_feature (1)..(560): AHJ57411 A/Shanghai/PD-01/2014 2014/01/17 HA 585478041

SEQ ID NO: 290 - protein, 560 aa, Influenza A virus; identical to SEQ ID NO: 94
  misc_feature (1)..(560): AHJ57418 A/Shanghai/PD-02/2014 2014/01/17 HA 585478256

SEQ ID NO: 291 - protein, 560 aa, Influenza A virus; identical to SEQ ID NO: 95
  misc_feature (1)..(560): AHK10800 A/Shanghai/01/2014 2014/01/03 HA 587681014

SEQ ID NO: 292 - protein, 560 aa, Influenza A virus; identical to SEQ ID NO: 96
  misc_feature (1)..(560): AHM24224 A/Beijing/3/2013 2013/04/16 HA 594704802

SEQ ID NO: 293 - protein, 560 aa, Influenza A virus; identical to SEQ ID NO: 97
  misc_feature (1)..(560): AHN96472 A/chicken/Shanghai/PD-CN-02/2014 2014/01/21 HA 602701641

SEQ ID NO: 294 - protein, 560 aa, Influenza A virus; identical to SEQ ID NO: 98
  misc_feature (1)..(560): AHZ39686 A/Anhui/DEWH72-01/2013 2013// HA 632807036

SEQ ID NO: 295 - protein, 560 aa, Influenza A virus; identical to SEQ ID NO: 99
  misc_feature (1)..(560): AHZ39710 A/Anhui/DEWH72-03/2013 2013// HA 632807076

SEQ ID NO: 296 - protein, 560 aa, Influenza A virus; identical to SEQ ID NO: 100
  misc_feature (1)..(560): AHZ39746 A/Anhui/DEWH72-06/2013 2013// HA 632807136

SEQ ID NO: 297 - protein, 560 aa, Influenza A virus; identical to SEQ ID NO: 101
  misc_feature (1)..(560): AHZ41929 A/mallard/Sweden/1621/2002 2002/12/12 HA 632810949

SEQ ID NO: 298 - protein, 560 aa, Influenza A virus; identical to SEQ ID NO: 102
  misc_feature (1)..(560): AHZ42537 A/mallard/Minnesota/AI09-3770/2009 2009/09/12 HA 632811964

SEQ ID NO: 299 - protein, 561 aa, Influenza A virus; identical to SEQ ID NO: 103
  misc_feature (1)..(561): AHZ42549 A/ruddy turnstone/Delaware/AI00-1538/2000 2000/05/20 HA 632811984

SEQ ID NO: 300 - protein, 560 aa, Influenza A virus; identical to SEQ ID NO: 104
  misc_feature (1)..(560): AID70634 A/Shanghai/Mix1/2014 2014/01/03 HA 660304650

SEQ ID NO: 301 - protein, 560 aa, Influenza A virus; identical to SEQ ID NO: 105
  misc_feature (1)..(560): AIN76383 A/Zhejiang/LS01/2014 2014/02/08 HA 684694637

SEQ ID NO: 302 - protein, 560 aa, Influenza A virus; identical to SEQ ID NO: 106
  misc_feature (1)..(560): AIU46619 A/chicken/Zhejiang/DTID-ZJU06/2013 2013/12/ HA 699978931

SEQ ID NO: 303 - protein, 560 aa, Influenza A virus; identical to SEQ ID NO: 107
  misc_feature (1)..(560): AIU47013 A/chicken/Suzhou/040201H/2013 2013/04/ HA 699979673

SEQ ID NO: 304 - protein, 560 aa, Influenza A virus; identical to SEQ ID NO: 108
  misc_feature (1)..(560): AJJ90490 A/chicken/Shenzhen/742/2013 2013/12/10 HA 755178094

SEQ ID NO: 305 - protein, 560 aa, Influenza A virus; identical to SEQ ID NO: 109
  misc_feature (1)..(560): AJJ90526 A/chicken/Shenzhen/898/2013 2013/12/09 HA 755178154

SEQ ID NO: 306 - protein, 560 aa, Influenza A virus; identical to SEQ ID NO: 110
  misc_feature (1)..(560): AJJ90538 A/silkie chicken/Shenzhen/918/2013 2013/12/09 HA 755178174

SEQ ID NO: 307 - protein, 560 aa, Influenza A virus; identical to SEQ ID NO: 111
  misc_feature (1)..(560): AJJ90576 A/chicken/Shenzhen/1665/2013 2013/12/12 HA 755178238

SEQ ID NO: 308 - protein, 560 aa, Influenza A virus; identical to SEQ ID NO: 112
  misc_feature (1)..(560): AJJ90588 A/chicken/Shenzhen/2110/2013 2013/12/13 HA 755178258

SEQ ID NO: 309 - protein, 560 aa, Influenza A virus; identical to SEQ ID NO: 113
  misc_feature (1)..(560): AJJ90661 A/chicken/Dongguan/2912/2013 2013/12/18 HA 755178380

SEQ ID NO: 310 - protein, 560 aa, Influenza A virus; identical to SEQ ID NO: 114
  misc_feature (1)..(560): AJJ90673 A/silkie chicken/Dongguan/3049/2013 2013/12/18 HA 755178400

SEQ ID NO: 311 - protein, 560 aa, Influenza A virus; identical to SEQ ID NO: 115
  misc_feature (1)..(560): AJJ90795 A/silkie chicken/Dongguan/3281/2013 2013/12/18 HA 755178604

SEQ ID NO: 312 - protein, 560 aa, Influenza A virus; identical to SEQ ID NO: 116
  misc_feature (1)..(560): AJJ90891 A/silkie chicken/Dongguan/3520/2013 2013/12/19 HA 755178764
  misc_feature (183)..(183): Xaa can be any naturally occurring amino acid

SEQ ID NO: 313 - protein, 560 aa, Influenza A virus; identical to SEQ ID NO: 117
  misc_feature (1)..(560): AJJ90951 A/chicken/Dongguan/3544/2013 2013/12/19 HA 755178864

SEQ ID NO: 314 - protein, 560 aa, Influenza A virus; identical to SEQ ID NO: 118
  misc_feature (1)..(560): AJJ91035 A/chicken/Shenzhen/3780/2013 2013/12/19 HA 755179004

SEQ ID NO: 315 - protein, 560 aa, Influenza A virus; identical to SEQ ID NO: 119
  misc_feature (1)..(560): AJJ91155 A/chicken/Dongguan/4037/2013 2013/12/19 HA 755179204

SEQ ID NO: 316 - protein, 560 aa, Influenza A virus; identical to SEQ ID NO: 120
  misc_feature (1)..(560): AJJ92005 A/chicken/Shenzhen/801/2013 2013/12/09 HA 755180629

SEQ ID NO: 317 - protein, 560 aa, Influenza A virus; identical to SEQ ID NO: 121
  misc_feature (1)..(560): AJJ94254 A/chicken/Dongguan/1374/2014 2014/02/21 HA 755184382

SEQ ID NO: 318 - protein, 560 aa, Influenza A virus; identical to SEQ ID NO: 122
  misc_feature (1)..(560): AJJ94606 A/chicken/Dongguan/191/2014 2014/02/20 HA 755184968

SEQ ID NO: 319 - protein, 560 aa, Influenza A virus; identical to SEQ ID NO: 123
  misc_feature (1)..(560): AJJ96552 A/chicken/Jiangxi/12206/2014 2014/03/16 HA 755188219

SEQ ID NO: 320 - protein, 560 aa, Influenza A virus; identical to SEQ ID NO: 124
  misc_feature (1)..(560): AJJ96684 A/chicken/Jiangxi/13207/2014 2014/03/30 HA 755188439

SEQ ID NO: 321 - protein, 560 aa, Influenza A virus; identical to SEQ ID NO: 125
  misc_feature (1)..(560): AJJ96732 A/chicken/Jiangxi/13223/2014 2014/03/30 HA 755188519

SEQ ID NO: 322 - protein, 560 aa, Influenza A virus; identical to SEQ ID NO: 126
  misc_feature (1)..(560): AJK00354 A/duck/Zhejiang/LS02/2014 2014/01/12 HA 755194469

SEQ ID NO: 323 - protein, 560 aa, Influenza A virus; identical to SEQ ID NO: 127
  misc_feature (1)..(560): AJJ91264 A/silkie chicken/Dongguan/4129/2013 2013/12/19 HA 755179386

SEQ ID NO: 324 - protein, 560 aa, Influenza A virus; identical to SEQ ID NO: 128
  misc_feature (1)..(560): AJJ91314 A/chicken/Shaoxing/2417/2013 2013/10/20 HA 755179470

SEQ ID NO: 325 - protein, 560 aa, Influenza A virus; identical to SEQ ID NO: 129
  misc_feature (1)..(560): AJJ91402 A/chicken/Huzhou/4045/2013 2013/10/24 HA 755179618

SEQ ID NO: 326 - protein, 560 aa, Influenza A virus; identical to SEQ ID NO: 130
  misc_feature (1)..(560): AJJ91476 A/chicken/Huzhou/4076/2013 2013/10/24 HA 755179743

SEQ ID NO: 327 - protein, 560 aa, Influenza A virus; identical to SEQ ID NO: 131
  misc_feature (1)..(560): AJJ91725 A/chicken/Shaoxing/5201/2013 2013/10/28 HA 755180161

SEQ ID NO: 328 - protein, 560 aa, Influenza A virus; identical to SEQ ID NO: 132
  misc_feature (1)..(560): AJJ91885 A/Shenzhen/SP4/2014 2014/01/16 HA 755180429

SEQ ID NO: 329 - protein, 560 aa, Influenza A virus; identical to SEQ ID NO: 133
  misc_feature (1)..(560): AJJ91909 A/Shenzhen/SP26/2014 2014/01/20 HA 755180469

SEQ ID NO: 330 - protein, 560 aa, Influenza A virus; identical to SEQ ID NO: 134
  misc_feature (1)..(560): AJJ91945 A/Shenzhen/SP38/2014 2014/01/22 HA 755180529

SEQ ID NO: 331 - protein, 560 aa, Influenza A virus; identical to SEQ ID NO: 135
  misc_feature (1)..(560): AJJ91957 A/Shenzhen/SP44/2014 2014/01/23 HA 755180549

SEQ ID NO: 332 - protein, 560 aa, Influenza A virus; identical to SEQ ID NO: 136
  misc_feature (1)..(560): AJJ91969 A/Shenzhen/SP48/2014 2014/01/23 HA 755180569

SEQ ID NO: 333 - protein, 560 aa, Influenza A virus; identical to SEQ ID NO: 137
  misc_feature (1)..(560): AJJ91993 A/chicken/Dongguan/4119/2013 2013/12/19 HA 755180609

SEQ ID NO: 334 - protein, 560 aa, Influenza A virus; identical to SEQ ID NO: 138
  misc_feature (1)..(560): AJJ92031 A/chicken/Dongguan/4064/2013 2013/12/19 HA 755180672

SEQ ID NO: 335 - protein, 560 aa, Influenza A virus; identical to SEQ ID NO: 139
  misc_feature (1)..(560): AJJ92967 A/silkie chicken/Jiangxi/9469/2014 2014/02/16 HA 755182232

SEQ ID NO: 336 - protein, 560 aa, Influenza A virus; identical to SEQ ID NO: 140
  misc_feature (1)..(560): AJJ93027 A/chicken/Jiangxi/9558/2014 2014/02/16 HA 755182332

SEQ ID NO: 337 - protein, 560 aa, Influenza A virus; identical to SEQ ID NO: 141
  misc_feature (1)..(560): AJJ93051 A/chicken/Jiangxi/10573/2014 2014/02/18 HA 755182372

SEQ ID NO: 338 - protein, 560 aa, Influenza A virus; identical to SEQ ID NO: 142
  misc_feature (1)..(560): AJJ93845 A/silkie chicken/Dongguan/157/2014 2014/02/20 HA 755183695

SEQ ID NO: 339 - protein, 560 aa, Influenza A virus; identical to SEQ ID NO: 143
  misc_feature (1)..(560): AJJ93857 A/chicken/Dongguan/169/2014 2014/02/20 HA 755183715

SEQ ID NO: 340 - protein, 560 aa, Influenza A virus; identical to SEQ ID NO: 144
  misc_feature (1)..(560): AJJ93869 A/chicken/Dongguan/173/2014 2014/02/20 HA 755183735

SEQ ID NO: 341 - protein, 560 aa, Influenza A virus; identical to SEQ ID NO: 145
  misc_feature (1)..(560): AJJ93881 A/chicken/Dongguan/189/2014 2014/02/20 HA 755183755

SEQ ID NO: 342 - protein, 560 aa, Influenza A virus; identical to SEQ ID NO: 146
  misc_feature (1)..(560): AJJ93907 A/chicken/Dongguan/449/2014 2014/02/20 HA 755183799

SEQ ID NO: 343 - protein, 560 aa, Influenza A virus; identical to SEQ ID NO: 147
  misc_feature (1)..(560): AJJ93931 A/chicken/Dongguan/536/2014 2014/02/20 HA 755183839

SEQ ID NO: 344 - protein, 560 aa, Influenza A virus; identical to SEQ ID NO: 148
  misc_feature (1)..(560): AJJ93943 A/chicken/Dongguan/568/2014 2014/02/20 HA 755183859

SEQ ID NO: 345 - protein, 560 aa, Influenza A virus; identical to SEQ ID NO: 149
  misc_feature (1)..(560): AJJ93979 A/silkie chicken/Dongguan/656/2014 2014/02/20 HA 755183919

SEQ ID NO: 346 - protein, 560 aa, Influenza A virus; identical to SEQ ID NO: 150
  misc_feature (1)..(560): AJJ94134 A/chicken/Dongguan/1051/2014 2014/02/21 HA 755184182
  misc_feature (516)..(516): Xaa can be any naturally occurring amino acid
  misc_feature (519)..(519): Xaa can be any naturally occurring amino acid

SEQ ID NO: 347 - protein, 560 aa, Influenza A virus; identical to SEQ ID NO: 151
  misc_feature (1)..(560): AJJ94158 A/chicken/Dongguan/1075/2014 2014/02/21 HA 755184222

SEQ ID NO: 348 - protein, 560 aa, Influenza A virus; identical to SEQ ID NO: 152
  misc_feature (1)..(560): AJJ94182 A/chicken/Dongguan/1177/2014 2014/02/21 HA 755184262

SEQ ID NO: 349 - protein, 560 aa, Influenza A virus; identical to SEQ ID NO: 153
  misc_feature (1)..(560): AJJ94194 A/silkie chicken/Dongguan/1264/2014 2014/02/21 HA 755184282

SEQ ID NO: 350 - protein, 560 aa, Influenza A virus; identical to SEQ ID NO: 154
  misc_feature (1)..(560): AJJ94206 A/silkie chicken/Dongguan/1268/2014 2014/02/21 HA 755184302

SEQ ID NO: 351 - protein, 560 aa, Influenza A virus; identical to SEQ ID NO: 155
  misc_feature (1)..(560): AJJ94344 A/silkie chicken/Dongguan/1451/2014 2014/02/21 HA 755184532

SEQ ID NO: 352 - protein, 560 aa, Influenza A virus; identical to SEQ ID NO: 156
  misc_feature (1)..(560): AJJ94356 A/chicken/Dongguan/1456/2014 2014/02/21 HA 755184552

SEQ ID NO: 353 - protein, 560 aa, Influenza A virus; identical to SEQ ID NO: 157
  misc_feature (1)..(560): AJJ94396 A/chicken/Dongguan/1494/2014 2014/02/21 HA 755184618

SEQ ID NO: 354 - protein, 560 aa, Influenza A virus; identical to SEQ ID NO: 158
  misc_feature (1)..(560): AJJ94754 A/chicken/Dongguan/748/2014 2014/02/20 HA 755185215

SEQ ID NO: 355 - protein, 560 aa, Influenza A virus; identical to SEQ ID NO: 159
  misc_feature (1)..(560): AJJ94838 A/chicken/Dongguan/835/2014 2014/02/20 HA 755185356

SEQ ID NO: 356 - protein, 560 aa, Influenza A virus; identical to SEQ ID NO: 160
  misc_feature (1)..(560): AJJ94862 A/chicken/Dongguan/843/2014 2014/02/20 HA 755185396

SEQ ID NO: 357 - protein, 560 aa, Influenza A virus; identical to SEQ ID NO: 161
  misc_feature (1)..(560): AJJ94886 A/chicken/Dongguan/851/2014 2014/02/20 HA 755185436

SEQ ID NO: 358 - protein, 560 aa, Influenza A virus; identical to SEQ ID NO: 162
  misc_feature (1)..(560): AJJ94910 A/chicken/Dongguan/874/2014 2014/02/20 HA 755185476

SEQ ID NO: 359 - protein, 560 aa, Influenza A virus; identical to SEQ ID NO: 163
  misc_feature (1)..(560): AJJ94959 A/silkie chicken/Dongguan/967/2014 2014/02/21 HA 755185558
  misc_feature (148)..(148): Xaa can be any naturally occurring amino acid

SEQ ID NO: 360 - protein, 560 aa, Influenza A virus; identical to SEQ ID NO: 164
  misc_feature (1)..(560): AJJ95048 A/chicken/Dongguan/1009/2014 2014/02/21 HA 755185708

SEQ ID NO: 361 - protein, 560 aa, Influenza A virus; identical to SEQ ID NO: 165
  misc_feature (1)..(560): AJJ95171 A/chicken/Dongguan/1314/2014 2014/02/21 HA 755185913

SEQ ID NO: 362 - protein, 560 aa, Influenza A virus; identical to SEQ ID NO: 166
  misc_feature (1)..(560): AJJ95227 A/chicken/Dongguan/1382/2014 2014/02/21 HA 755186006

SEQ ID NO: 363 - protein, 560 aa, Influenza A virus; identical to SEQ ID NO: 167
  misc_feature (1)..(560): AJJ95251 A/chicken/Dongguan/1401/2014 2014/02/21 HA 755186046

SEQ ID NO: 364 - protein, 560 aa, Influenza A virus; identical to SEQ ID NO: 168
  misc_feature (1)..(560): AJJ95346 A/chicken/Dongguan/1548/2014 2014/02/21 HA 755186206

SEQ ID NO: 365 - protein, 560 aa, Influenza A virus; identical to SEQ ID NO: 169
  misc_feature (1)..(560): AJJ95382 A/chicken/Dongguan/1690/2014 2014/02/21 HA 755186266

SEQ ID NO: 366 - protein, 560 aa, Influenza A virus; identical to SEQ ID NO: 170
  misc_feature (1)..(560): AJJ95464 A/chicken/Shenzhen/138/2014 2014/02/19 HA 755186404

SEQ ID NO: 367 - protein, 560 aa, Influenza A virus; identical to SEQ ID NO: 171
  misc_feature (1)..(560): AJJ95572 A/chicken/Dongguan/1100/2014 2014/02/21 HA 755186584

SEQ ID NO: 368 - protein, 560 aa, Influenza A virus; identical to SEQ ID NO: 172
  misc_feature (1)..(560): AJJ95584 A/silkie chicken/Dongguan/1519/2014 2014/02/21 HA 755186604

SEQ ID NO: 369 - protein, 560 aa, Influenza A virus; identical to SEQ ID NO: 173
  misc_feature (1)..(560): AJJ95596 A/Shenzhen/SP58/2014 2014/01/25 HA 755186624

SEQ ID NO: 370 - protein, 560 aa, Influenza A virus; identical to SEQ ID NO: 174
  misc_feature (1)..(560): AJJ95620 A/Shenzhen/SP75/2014 2014/02/15 HA 755186664

SEQ ID NO: 371 - protein, 560 aa, Influenza A virus; identical to SEQ ID NO: 175
  misc_feature (1)..(560): AJJ95632 A/Shenzhen/SP62/2014 2014/02/05 HA 755186684

SEQ ID NO: 372 - protein, 560 aa, Influenza A virus; identical to SEQ ID NO: 176
  misc_feature (1)..(560): AJJ96720 A/chicken/Jiangxi/13220/2014 2014/03/30 HA 755188499

SEQ ID NO: 373 - protein, 560 aa, Influenza A virus; identical to SEQ ID NO: 177
  misc_feature (1)..(560): AJJ96817 A/chicken/Jiangxi/9513/2014 2014/02/16 HA 755188661

SEQ ID NO: 374 - protein, 560 aa, Influenza A virus; identical to SEQ ID NO: 178
  misc_feature (1)..(560): AJJ96841 A/Shenzhen/SP139/2014 2014/04/02 HA 755188701

SEQ ID NO: 375 - protein, 560 aa, Influenza A virus; identical to SEQ ID NO: 179
  misc_feature (1)..(560): AJJ96889 A/chicken/Jiangxi/13496/2014 2014/04/11 HA 755188781
  misc_feature (55)..(55): Xaa can be any naturally occurring amino acid
  misc_feature (129)..(129): Xaa can be any naturally occurring amino acid
  misc_feature (294)..(294): Xaa can be any naturally occurring amino acid

SEQ ID NO: 376 - protein, 560 aa, Influenza A virus; identical to SEQ ID NO: 180
  misc_feature (1)..(560): AJJ96901 A/chicken/Jiangxi/13502/2014 2014/04/11 HA 755188801
  misc_feature (294)..(294): Xaa can be any naturally occurring amino acid

SEQ ID NO: 377 - protein, 560 aa, Influenza A virus; identical to SEQ ID NO: 181
  misc_feature (1)..(560): AJJ96925 A/chicken/Jiangxi/13513/2014 2014/04/11 HA 755188841

SEQ ID NO: 378 - protein, 560 aa, Influenza A virus; identical to SEQ ID NO: 182
  misc_feature (1)..(560): AJJ97267 A/chicken/Jiangxi/13252/2014 2014/03/30 HA 755189411

SEQ ID NO: 379 - protein, 560 aa, Influenza A virus; identical to SEQ ID NO: 183
  misc_feature (1)..(560): AJJ97291 A/chicken/Jiangxi/13493/2014 2014/04/06 HA 755189451

SEQ ID NO: 380 - protein, 560 aa, Influenza A virus; identical to SEQ ID NO: 184
  misc_feature (1)..(560): AJJ97331 A/chicken/Jiangxi/13512/2014 2014/04/06 HA 755189517

SEQ ID NO: 381 - protein, 560 aa, Influenza A virus; identical to SEQ ID NO: 185
  misc_feature (1)..(560): AJJ97373 A/chicken/Jiangxi/13521/2014 2014/04/06 HA 755189587
  misc_feature (264)..(264): Xaa can be any naturally occurring amino acid
  misc_feature (274)..(274): Xaa can be any naturally occurring amino acid

SEQ ID NO: 382 - protein, 560 aa, Influenza A virus; identical to SEQ ID NO: 186
  misc_feature (1)..(560): AJJ97443 A/chicken/Jiangxi/13530/2014 2014/04/06 HA 755189702

SEQ ID NO: 383 - protein, 560 aa, Influenza A virus; identical to SEQ ID NO: 187
  misc_feature (1)..(560): AJJ97582 A/chicken/Jiangxi/14023/2014 2014/04/13 HA 755189933

SEQ ID NO: 384 - protein, 560 aa, Influenza A virus; identical to SEQ ID NO: 188
  misc_feature (1)..(560): AJJ97697 A/chicken/Jiangxi/14517/2014 2014/04/20 HA 755190125

SEQ ID NO: 385 - protein, 560 aa, Influenza A virus; identical to SEQ ID NO: 189
  misc_feature (1)..(560): AJJ97709 A/chicken/Jiangxi/14518/2014 2014/04/20 HA 755190145

SEQ ID NO: 386 - protein, 560 aa, Influenza A virus; identical to SEQ ID NO: 190
  misc_feature (1)..(560): AJJ97745 A/chicken/Jiangxi/14554/2014 2014/04/20 HA 755190205

SEQ ID NO: 387 - protein, 560 aa, Influenza A virus; identical to SEQ ID NO: 191
  misc_feature (1)..(560): AJJ97757 A/chicken/Shantou/2537/2014 2014/04/16 HA 755190225

SEQ ID NO: 388 - protein, 560 aa, Influenza A virus; identical to SEQ ID NO: 192
  misc_feature (1)..(560): AJJ97841 A/duck/Jiangxi/15044/2014 2014/04/27 HA 755190365

SEQ ID NO: 389 - protein, 560 aa, Influenza A virus; identical to SEQ ID NO: 193
  misc_feature (1)..(560): AJJ97899 A/chicken/Jiangxi/15524/2014 2014/05/05 HA 755190462

SEQ ID NO: 390 - protein, 560 aa, Influenza A virus; identical to SEQ ID NO: 194
  misc_feature (1)..(560): AJJ97925 A/silkie chicken/Shantou/2050/2014 2014/03/25 HA 755190506

SEQ ID NO: 391 - protein, 560 aa, Influenza A virus; identical to SEQ ID NO: 195
  misc_feature (1)..(560): AJJ97973 A/chicken/Shantou/4325/2014 2014/07/01 HA 755190586

SEQ ID NO: 392 - protein, 560 aa, Influenza A virus; identical to SEQ ID NO: 196
  misc_feature (1)..(560): AJJ97998 A/chicken/Shantou/4816/2014 2014/07/22 HA 755190628

SEQ ID NO: 393 - DNA, 1778 bp, Influenza A virus
  misc_feature (1)..(1778): H1
agcaaaagcaggggaaaataaaaacaaccaaaatgaaggcaaacctactggtcctgttatgtgcacttgcagctgcagatgcagacacaatatgtataggctaccatgcgaacaattcaaccgacactgttgacacagtgctcgagaagaatgtgacagtgacacactctgttaacctgctcgaagacagccacaacggaaaactatgtagattaaaaggaatagccccactacaattggggaaatgtaacatcgccggatggctcttgggaaacccagaatgcgacccactgcttccagtgagatcatggtcctacattgtagaaacaccaaactctgagaatggaatatgttatccaggagatttcatcgactatgaggagctgagggagcaattgagctcagtgtcatcattcgaaagattcgaaatatttcccaaagaaagctcatggcccaaccacaacacaaccaaaggagtaacggcagcatgctcccatgcggggaaaagcagtttttacagaaatttgctatggctgacggagaaggagggctcatacccaaagctgaaaaattcttatgtgaacaagaaagggaaagaagtccttgtactgtggggtattcatcacccgtctaacagtaaggatcaacagaatatctatcagaatgaaaatgcttatgtctctgtagtgacttcaaattataacaggagatttaccccggaaatagcagaaagacccaaagtaagagatcaagctgggaggatgaactattactggaccttgctaaaacccggagacacaataatatttgaggcaaatggaaatctaatagcaccaaggtatgctttcgcactgagtagaggctttgggtccggcatcatcacctcaaacgcatcaatgcatgagtgtaacacgaagtgtcaaacacccctgggagctataaacagcagtctccctttccagaatatacacccagtcacaataggagagtgcccaaaatacgtcaggagtgccaaattgaggatggttacaggactaaggaacattccgtccattcaatccagaggtctatttggagccattgccggttttattgaagggggatggactggaatgatagatggatggtacggttatcatcatcagaatgaacagggatcaggctatgcagcggatcaaaaaagcacacaaaatgccattaacgggattacaaacaaggtgaactctgttatcgagaaaatgaacattcaattcacagctgtgggtaaagaattcaacaaattagaaaaaaggatggaaaatttaaataaaaaagttgatgatggatttctggacatttggacatataatgcagaattgttagttctactggaaaatgaaaggactctggatttccatgactcaaatgtgaagaatctgtatgagaaagtaaaaagccaattaaagaataatgccaaagaaatcggaaatggatgttttgagttctaccacaagtgtgacaatgaatgcatggaaagtgtaagaaatgggacttatgattatcccaaatattcagaagagtcaaagttgaacagggaaaaggtagatggagtgaaattggaatcaatggggatctatcagattctggcgatctactcaactgtcgccagttcactggtgcttttggtctccctgggggcaatcagtttctggatgtgttctaatggatctttgcagtgcagaatatgcatctgagattagaatttcagaaatatgaggaaaaacacccttgtttctact

SEQ ID NO: 394 - DNA, 1732 bp, Influenza A virus
  misc_feature (1)..(1732): H7
agcgaaagcaggggatacaaaatgaacactcaaatcctggtattcgctctgattgcgatcattccaacaaatgcagacaaaatctgcctcggacatcatgccgtgtcaaacggaaccaaagtaaacacattaactgaaagaggagtggaagtcgtcaatgcaactgaaacagtggaacgaacaaacatccccaggatctgctcaaaagggaaaaggacagttgacctcggtcaatgtggactcctggggacaatcactggaccacctcaatgtgaccaattcctagaattttcagccgatttaattattgagaggcgagaaggaagtgatgtctgttatcctgggaaattcgtgaatgaagaagctctgaggcaaattctcagagaatcaggcggaattgacaaggaagcaatgggattcacatacagtggaataagaactaatggagcaaccagtgcatgtaggagatcaggatcttcattctatgcagaaatgaaatggctcctgtcaaacacagatgatgctgcattcccgcagatgactaagtcatataaaaatacaagaaaaagcccagctctaatagtatgggggatccatcattccgtatcaactgcagagcaaaccaagctatatgggagtggaaacaaactggtgacagttgggagttctaattatcaacaatcttttgtaccgagtccaggagcgagaccacaagttaatggtctatctggaagaattgactttcattggctaatgctaaatcccaatgatacagtcactttcagtttcaatggggctttcatagctccagaccgtgcaagcttcctgagaggaaaatctatgggaatccagagtggagtacaggttgatgccaattgtgaaggggactgctatcatagtggagggacaataataagtaacttgccatttcagaacatagatagcagggcagttggaaaatgtccgagatatgttaagcaaaggagtctgctgctagcaacagggatgaagaatgttcctgagattccaaagggaagaggcctatttggtgctatagcgggtttcattgaaaatggatgggaaggcctaattgatggttggtatggtttcagacaccagaatgcacagggagagggaactgctgcagattacaaaagcactcaatcggcaattgatcaaataacaggaaaattaaaccggcttatagaaaaaaccaaccaacaatttgagttgatagacaatgaattcaatgaggtagagaagcaaatcggtaatgtgataaattggaccagagattctataacagaagtgtggtcatacaatgctgaactcttggtagcaatggagaaccagcatacaattgatctggctgattcagaaatggacaaactgtacgaacgagtgaaaagacagctgagagagaatgctgaagaagatggcactggttgctttgaaatatttcacaagtgtgatgatgactgtatggccagtattagaaataacacctatgatcacagcaaatacagggaagaggcaatgcaaaatagaatacagattgacccagtcaaactaagcagcggctacaaagatgtgatactttggtttagcttcggggcatcatgtttcatacttctagccattgtaatgggccttgtcttcatatgtgtaaagaatggaaacatgcggtgcactatttgtatataagtttggaaaaaaacacccttgtttctac

SEQ ID NO: 395 - DNA, 1686 bp, Influenza A virus
  misc_feature (1)..(1686): H10
atgtacaaaatagtagtgataatcgcgctccttggagctgtgaaaggtcttgataaaatctgtctaggacatcatgcagtggctaatgggaccatcgtaaagactctcacaaacgaacaggaagaggtaaccaacgctactgaaacagtggagagtacaggcataaacagattatgtatgaaaggaagaaaacataaagacctgggcaactgccatccaatagggatgctaatagggactccagcttgtgatctgcaccttacagggatgtgggacactctcattgaacgagagaatgctattgcttactgctaccctggagctactgtaaatgtagaagcactaaggcagaagataatggagagtggagggatcaacaagataagcactggcttcacttatggatcttccataaactcggccgggaccactagagcgtgcatgaggaatggagggaatagcttttatgcagagcttaagtggctggtatcaaagagcaaaggacaaaacttccctcagaccacgaacacttacagaaatacagacacggctgaacacctcataatgtggggaattcatcacccttctagcactcaagagaagaatgatctatatggaacacaatcactgtccatatcagtcgggagttccacttaccggaacaattttgttccggttgttggagcaagacctcaggtcaatggacaaagtggcagaattgattttcactggacactagtacagccaggtgacaacatcaccttctcacacaatgggggcctgatagcaccgagccgagttagcaaattaattgggaggggattgggaatccaatcagacgcaccaatagacaataattgtgagtccaaatgtttttggagagggggttctataaatacaaggcttccctttcaaaatttgtcaccaagaacagtgggtcagtgtcctaaatatgtgaacagaagaagcttgatgcttgcaacaggaatgagaaacgtaccagaactaatacaagggagaggtctatttggtgcaatagcagggtttttagagaatgggtgggaaggaatggtagatggctggtatggtttcagacatcaaaatgctcagggcacaggccaggccgctgattacaagagtactcaggcagctattgatcaaatcactgggaaactgaatagacttgttgaaaaaaccaatactgagttcgagtcaatagaatctgagttcagtgagatcgaacaccaaatcggtaacgtcatcaattggactaaggattcaataaccgacatttggacttatcaggctgagctgttggtggcaatggagaaccagcatacaatcgacatggctgactcagagatgttgaatctatatgaaagagtgaggaaacaactaaggcagaatgcagaagaagatgggaaaggatgttttgagatatatcatgcttgtgatgattcatgcatggagagcataagaaacaacacctatgaccattcacagtacagagaggaagctcttttgaacagattgaatatcaacccagtgacactctcttctggatataaagacatcattctctggtttagcttcggggcatcatgttttgttcttctagccgttgtcatgggtcttttctttttctgtctgaagaatggaaacatgcgatgcacaatctgtatttag

SEQ ID NO: 396 - DNA, 1695 bp, Influenza A virus
  misc_feature (1)..(1695): Codon Optimized Sequence Encoding H1 Hemagglutinin
atgaaggcaaacctcttagtccttctctgcgcactggccgctgccgacgcagataccatatgtatcggttatcacgccaataactctaccgatacagtcgatacggtgcttgagaaaaacgtcaccgtgactcatagcgtgaacctgctcgaggactcccataacggtaagctatgccgactaaagggcatcgcccccctgcagctggggaaatgcaacatcgctggctggttgttaggtaatcccgaatgcgatccactgctgcccgtgagatcctggtcttacatcgtcgaaacccctaactctgaaaatggcatctgctatccgggagactttattgactatgaggagctccgagaacagctgagctcagtatccagctttgaacgcttcgaaatttttccaaaggaatccagctggccaaaccataacacgaatggcgtcacagccgcatgcagccacgagggaaagagcagcttttataggaaccttctgtggttgacggaaaaagagggaagttatcccaaacttaaaaacagctatgtgaataaaaagggcaaggaggtcttggtactttggggaatccatcaccctccaaacagtaaggaacaacaaaatctgtaccagaatgaaaatgcatacgtgtccgtggttacatctaattacaaccgacggtttactcccgagatcgccgagcgaccgaaagttcgcgaccaggccgggaggatgaactattattggacgttgctgaaacccggtgacacaattatctttgaggcaaatggtaatcttatcgccccgatgtacgcattcgcactgtcgcgcggatttggcagtgggattataaccagtaacgcatctatgcatgaatgcaacacaaagtgccagactcctttaggcgctataaactcttctttgccctatcagaatatacacccagtgaccatcggcgagtgtccaaagtacgtacgcagcgccaagctccgaatggttacaggcctcagaaataaccccagtatccagagccgcggcttattcggggcgatcgctggatttattgaggggggctggacgggaatgatagatgggtggtacggctaccatcatcagaatgagcagggtagcggctatgcggccgaccagaaaagcacccagaacgctatcaacggtataaccaataaagtgaacactgtgatcgaaaaaatgaacatacagttcactgccgtgggaaaggaattcaacaaactggaaaaaaggatggaaaatcttaacaaaaaagtggatgacgggtttttggacatttggacatacaatgccgaactgctggttctgctggagaacgaaaggacactggactttcacgattccaacgtcaagaatctctatgaaaaagtgaagtcccaattgaaaaacaacgccaaggagatcggtaatgggtgctttgagttctatcacaagtgtgacaacgagtgcatggagagcgttaggaacggcacatacgattacccaaaatattctgaggagtctaagttgaacagagagaaggtcgatggcgttaaactggaaagcatgggaatttaccagatccttgccatctactccaccgtggcctcctcccttgtgctgctggtgtcgctgggggccatctccttttggatgtgctccaatggttcactgcaatgtcgaatctgcatc

SEQ ID NO: 397 - DNA, 1695 bp, Influenza A virus
  misc_feature (1)..(1695): Codon Optimized Sequence Encoding H1 Hemagglutinin
atgaaggctaacctcctagtgctgctctgtgccttggcggctgcggatgctgacaccatttgcattgggtaccacgccaataattcaaccgatactgtcgacaccgtgttggagaagaatgtgaccgtgactcattccgtgaaccttcttgaagattcgcacaacgggaagctgtgtcgactcaaaggcatcgcgcctctacagttgggcaaatgtaacatcgctgggtggctgctcgggaacccagaatgtgatcctttgctgccagtgagatcgtggtcatacattgtggagacccccaattcagagaacgggatatgctacccaggtgactttatcgattatgaggaacttcgggaacaactgtcttcagtgtcgtcatttgagcgtttcgagatctttcccaaagagtcctcgtggccaaaccacaacactaacggcgttactgccgcctgctcacatgaaggaaagagctcattctacagaaacctgttgtggctcaccgagaaggaggggagttatcccaagttgaaaaacagttatgttaacaagaagggcaaagaagtgttagtcctgtggggaatccaccacccaccgaattctaaagagcagcagaatctatatcagaacgagaacgcctatgtgtcagttgtaacttcaaattacaaccgcaggtttactcctgaaatcgcggagcgcccgaaagtgcgtgatcaggctggacgtatgaattactactggactttgctaaaacctggcgacaccatcattttcgaagctaacggcaatctcattgcgccgatgtacgcctttgctctctctagggggttcgggtctgggatcattaccagcaatgcttccatgcacgagtgtaatacaaagtgccagactcccctcggcgcgattaatagctcgctcccctaccaaaacatacacccagtgacaattggcgagtgccctaaatatgtgcgctctgctaagttacgtatggtgacgggcctaagaaacaacccctcaattcagagcagggggctgttcggagctattgcaggtttcatcgaagggggctggacagggatgatcgacggctggtatgggtatcaccaccagaacgaacagggatccggctatgctgccgatcagaaatcaacacaaaatgcaatcaatggcatcactaacaaagtgaataccgtaattgagaagatgaacatacagtttaccgctgtcggtaaagaattcaacaagctggagaaacggatggagaatctgaacaagaaagtcgatgatggcttcttggatatctggacctataatgctgagttacttgtgctcttggaaaacgagcgtactctcgactttcatgattcaaatgtcaagaatctgtatgaaaaggtaaagtcccagctaaaaaacaatgccaaggagatcgggaatggctgctttgaattctaccacaaatgcgataatgagtgcatggagtcggtgaggaacggaacctacgattacccaaaatatagcgaggaatcaaaactgaacagagagaaggtggatggtgtgaagctggaatccatgggtatctaccagatcctcgccatctattcaactgtggctagttccctggtgctgctcgtgagccttggtgcaatctccttctggatgtgttccaacgggtcattgcagtgtaggatctgcata

SEQ ID NO: 398 - DNA, 1695 bp, Influenza A virus
  misc_feature (1)..(1695): Codon Optimized Sequence Encoding H1 Hemagglutinin
atgaaggctaacttgctggtcttgctttgcgcgctggccgctgctgacgccgacaccatctgtattgggtatcatgctaacaactccacggataccgtggatacagtgttggaaaaaaatgttacagttactcattcggtgaacctgctggaggactctcacaatgggaagctgtgcaggctcaaaggtatcgctccgctccaactaggcaaatgtaatattgccggctggctgttaggaaacccagagtgtgaccctctcttacccgtgagatcttggtcctacatcgtcgagacccccaacagcgaaaacggaatttgttatcccggagacttcatagattatgaggagctgcgcgaacagctctcttctgttagctcttttgagcgttttgagatctttcctaaagagagttcatggcccaaccacaataccaacggagtgacagccgcatgctcccatgaagggaagtctagcttctatagaaatcttctgtggctgactgaaaaagaaggatcttaccccaagttgaagaattcttatgtgaacaaaaagggcaaagaggtgttggtactctggggcattcatcacccacctaattcaaaggagcagcaaaacctttatcaaaacgagaatgcctatgttagcgtcgtcacttctaattataaccggagattcaccccggagatagcggaacgccccaaggttcgggatcaggctggccgcatgaattactactggaccctcctaaaacctggcgacaccataatcttcgaagcaaatggcaacctgatcgcacctatgtacgcctttgcgctgtctaggggattcggctcgggcattattaccagtaatgcctcaatgcacgagtgtaatacaaaatgccagacccctctgggagccattaattctagtctgccttatcagaatattcatcctgtgaccattggcgaatgtccgaaatatgttagatccgcaaagctgcgaatggttaccggacttcgcaacaacccctctatacaaagccgcggactctttggagcaatcgctggcttcattgagggtggctggacgggcatgatcgatgggtggtacggataccatcatcagaacgagcagggaagcggatatgccgcagaccaaaaatctactcagaacgctattaacggaattaccaacaaagtcaacacagttatcgagaaaatgaatattcagttcaccgcagttggtaaggaatttaacaaactggagaaacgaatggagaacttgaacaagaaggtcgacgatggcttcttagacatctggacatataatgccgaactgttggtcctcctggagaacgagagaaccttggactttcacgactctaacgtgaagaatctttacgagaaggtgaagtcccaactgaagaataatgcaaaagagatcggaaacggctgttttgagttctaccacaagtgcgacaatgagtgcatggagagcgtgcggaatgggacatatgattatcccaagtatagtgaagaaagcaagctgaatcgagaaaaggttgacggagtgaagctggagagcatggggatctaccagatcttagcaatttatagcacagtggcttcttcccttgtgttgctggtctcgctgggagctatcagcttttggatgtgcagcaacggaagtctgcagtgccgcatttgcatt

SEQ ID NO: 399 - DNA, 1695 bp, Influenza A virus
  misc_feature (1)..(1695): Codon Optimized Sequence Encoding H1 Hemagglutinin
atgaaagccaacctgttggtgctgttatgcgcgctggcagccgcagatgctgatactatctgtatcggataccatgccaataacagcaccgataccgtggatactgtgttagagaagaatgtgacagtgacgcattcagtaaacctcctcgaggacagtcataatggaaaactgtgtaggctcaagggtatagctccgctgcagctgggcaagtgtaacatcgctgggtggctgctgggcaaccctgaatgcgatcccctgttgcccgttcggagttggtcttacatcgtggagaccccaaactctgagaacggaatttgttaccccggtgactttatcgattacgaggaattgcgggagcagcttagctcagtgtcttcatttgaacggtttgaaatctttcccaaggaaagcagctggcccaatcataatactaacggcgtgactgccgcttgttcccacgaaggcaagagctccttctacagaaatctgctttggttgacagagaaagagggcagctatccaaagctgaagaacagttatgtgaataagaagggcaaggaggtcctggttctttgggggatccatcatccccctaatagtaaggagcagcagaacttataccagaatgagaatgcctacgtcagcgttgtcacctcaaactataaccggcgatttacacccgaaattgccgaacgtcccaaggtccgcgaccaagccgggcgtatgaactactattggacacttctgaaacctggggacacaataattttcgaagccaacggtaacttaatcgctcccatgtacgctttcgctctcagcaggggcttcggcagcggcattatcacttccaatgcgtccatgcatgaatgtaatacgaagtgccagacccctctcggtgccataaactcttctctcccctaccagaacattcaccctgtcaccataggagaatgcccaaagtatgtccggtcggcaaagttgaggatggttacgggcctgcgtaacaacccttctatacagtctaggggcctgttcggagcaatcgccggcttcatcgaaggaggctggactgggatgatcgatggctggtacggctatcatcaccagaatgagcagggctcaggttatgcagccgatcagaagtccacacagaacgctattaacgggataacgaacaaggtgaacaccgtcattgaaaagatgaacattcagtttacagccgttggaaaagagttcaacaaactggaaaagcggatggagaacctgaacaaaaaggtggacgatggatttctggatatttggacatataacgccgagctgctggtactccttgagaacgagcgtacgcttgactttcatgacagtaacgtgaagaatctgtacgagaaggtcaaaagccagctgaagaacaatgccaaagaaattgggaacgggtgtttcgaattctaccacaagtgtgacaatgaatgcatggagagtgttcggaacggaacctacgactatcctaaatattctgaggagtccaagctgaatcgggaaaaggttgacggggtgaaactggagagtatgggaatctaccagatcctggctatttactccacagtcgcttcctctctcgtcttgttggtgtcccttggtgccatctcattttggatgtgttctaatggttctcttcagtgccgaatctgtata

SEQ ID NO: 400 - DNA, 1695 bp, Influenza A virus
  misc_feature (1)..(1695): Codon Optimized Sequence Encoding H1 Hemagglutinin
atgaaagctaaccttctcgtattgctctgcgctttggctgcagccgatgccgatacgatttgcatcggataccacgcaaataacagcactgacactgtggacacggtactggaaaagaatgttaccgtgacacactccgtcaacctgctcgaggactcccacaacggaaagttgtgtaggcttaaaggtatcgcccctctacagttagggaagtgcaacatcgcagggtggttgttaggaaaccccgaatgtgacccactcctgcctgtgcgctcttggagctatattgtggaaaccccgaatagcgaaaacggaatttgttaccctggcgactttatcgattatgaagagctccgagagcaactgagcagcgtgtccagctttgagcgatttgaaatattccccaaagagagttcctggcccaaccataacactaacggagtgaccgctgcatgttcgcacgaaggcaaatcgagtttttaccggaacctgctttggctcaccgagaaggaaggaagttatcccaaactcaaaaattcatacgtgaataaaaagggtaaggaggtgctggtgctgtggggaatccaccatcctccaaacagcaaggaacaacagaatctctaccagaatgagaacgcctatgtgagcgtggtaacctccaactacaatcggcggttcactcctgagatcgccgagcgcccgaaggtccgggatcaagcaggtcgaatgaactactactggaccctgctgaagccaggtgatactatcattttcgaggctaatggaaacctgattgcgcctatgtacgctttcgccctgtctagggggtttgggtccggtatcatcacgtctaacgcttcaatgcatgaatgcaacacgaagtgtcagaccccgcttggcgccataaacagctccctcccctaccagaacattcaccccgtcaccataggcgagtgtcccaagtacgtgcggtcagccaagttgcggatggtaacgggcctccggaataatccaagtatacaatcccgaggacttttcggggcaatcgcgggcttcattgagggcggatggaccggcatgattgatggatggtacggttaccaccaccagaacgagcagggcagtggatatgccgctgaccagaagagcactcagaacgcaattaatggcatcaccaataaggtgaacaccgtcattgagaagatgaacatccagtttacggcagtaggcaaggagtttaacaagctggagaaacgtatggaaaacctgaataagaaagtggacgacgggtttttggatatttggacatataacgccgaactcctcgtgctgctcgagaatgaaagaacattagactttcacgatagtaacgtgaaaaacctgtatgaaaaggtcaaatcccagctaaagaacaacgccaaagagatcggcaatggctgttttgagttttaccacaagtgtgataatgaatgcatggaaagtgttcggaacggaacctacgattatccaaaatactcggaggagtccaaactgaatagagagaaggtggacggcgtcaaactagagagtatgggtatctatcagatacttgcgatctactcaaccgtcgccagctccttagtacttctcgtcagcctcggtgctatctccttttggatgtgtagtaacggcagtctgcagtgtcggatatgcatc

SEQ ID NO: 401 - DNA, 1695 bp, Influenza A virus
  misc_feature (1)..(1695): Codon Optimized Sequence Encoding H1 Hemagglutinin
atgaaggctaacctgttggtgctcctatgtgccctggccgctgcagatgctgacacaatctgcattgggtatcatgcaaacaactccaccgacactgttgacacagttttggaaaagaacgtgacagtcactcacagcgtaaacctcctggaagactcacacaatgggaagttatgtcggctgaagggcatagccccattgcaactgggcaagtgcaatatagcggggtggcttctcggcaacccggaatgcgaccccctgttgcccgtacgcagctggagttacattgtggagacgcccaattccgagaatggcatctgttacccgggcgatttcatagattacgaagaactgcgggagcagctctcctccgtttcctcgttcgaacggttcgagattttccctaaagaatcatcatggcctaatcacaatacaaatggcgtgacggccgcatgctcacacgagggcaagtccagcttttacagaaatctcctgtggctgacggagaaggaaggaagctaccctaagcttaagaatagctatgtaaacaaaaaggggaaggaggtgctggttctctgggggattcatcatccgccaaatagtaaggaacagcagaacctttaccagaatgagaatgcatacgtctctgtggtcacgtctaactacaatcggcgcttcacacccgagatcgctgaacggcccaaagtccgggaccaagccggacgaatgaattactactggacccttttgaagcccggcgataccattatcttcgaagcgaacgggaacctgatagctcccatgtacgcctttgctctcagtaggggattcggctccggcattattacctctaatgcttctatgcacgagtgcaacacaaaatgtcagactccgctcggtgccatcaacagttcgttgccataccagaatatacaccccgtcactatcggggaatgtcctaaatacgtgaggagcgccaaactcaggatggtcactggactcaggaataatccaagcatccagtcgaggggcttattcggagcaattgctggcttcatcgaaggcgggtggactggcatgatcgatggatggtatgggtaccaccaccagaacgaacaaggtagcggatatgccgctgaccagaaatcaacacaaaacgccatcaacggtattaccaacaaggttaacactgttattgagaagatgaatatccaatttaccgccgtagggaaggagtttaataagttggagaaacgtatggagaatctgaacaagaaagttgacgacggatttctggacatctggacctacaacgccgagctgttagtgctgttggaaaatgagagaacccttgacttccatgatagcaacgtgaaaaacctatatgaaaaggtcaagtcccagctgaagaacaatgcaaaggaaataggcaatggctgcttcgagttttatcataaatgcgacaacgaatgtatggaaagcgtccgaaacggcacttatgactatcccaaatatagcgaagagtcaaagctgaatcgggaaaaggtggacggggtcaagctcgagtcaatggggatctaccagattcttgcaatctattccacagtggcgtcttccctcgtgctgctggttagtctcggcgccatatcattttggatgtgcagcaatggctccctgcagtgtcggatctgtatc

SEQ ID NO: 402 - DNA, 1695 bp, Influenza A virus
  misc_feature (1)..(1695): Codon Optimized Sequence Encoding H1 Hemagglutinin
atgaaggcgaacttgctggtcctgttgtgcgctttagctgctgcggatgccgatacaatctgtatcgggtatcacgcaaacaacagtacagataccgtggatacagttctcgagaagaatgtcactgttacgcacagtgtaaacctgctggaggacagtcacaatgggaagctgtgccggctaaagggcattgcgccactacagctcggcaagtgcaatattgcggggtggttattgggtaaccccgaatgcgacccactattgccagtgcgctcttggtcgtacatcgtcgaaacccccaattcagaaaatggcatttgctacccaggggattttatagactacgaagagttacgagaacaattaagtagtgtttcttcctttgagcgattcgagattttccccaaggagagttcttggcccaaccataacacaaatggagtgactgccgcatgctcacacgagggcaaatcatccttttatagaaacctgctttggctgactgaaaaggaggggagttacccgaagcttaaaaactcctatgtgaacaagaagggcaaggaagtgctggtcctgtgggggatccaccacccacccaactccaaagagcaacagaacctctaccagaacgagaatgcgtatgtgagcgtggtgacaagtaactataatcgaaggttcactcccgagatagcagagcgtccaaaagtgcgagatcaagccggccgaatgaactactattggaccttactgaaacccggcgataccatcatattcgaagctaacggcaatctcatagctcctatgtacgctttcgctttgagtagaggtttcggatctggaattataacatctaatgcatcaatgcacgagtgcaatactaaatgccagacccctcttggtgctatcaactctagtttaccctatcagaacatccaccctgtgacgataggagagtgtcccaagtatgtgcgctccgctaagcttagaatggtcaccgggcttcggaacaacccttcaatccaaagtcgagggctttttggcgctatcgctggcttcatcgaaggcggttggacaggtatgatcgatggttggtacggctaccatcatcagaacgagcaggggtctggttatgcggccgaccaaaaatctactcagaatgccatcaacgggatcacaaataaggtaaacactgtgattgagaagatgaacatccagtttactgcagtgggaaaggagtttaacaaactggagaaacgtatggaaaacctaaacaaaaaagtggacgacggattcttagacatttggacatacaacgccgagctgctcgtgctgcttgagaatgagcggacactcgacttccacgacagcaacgtgaagaacctatacgaaaaggtcaagagccagctcaagaataacgcgaaggagattggaaacggctgcttcgagttctaccataagtgcgataacgaatgtatggagtctgttcggaatggcacttacgactacccaaagtatagcgaggaatctaagctcaaccgagagaaggtggatggagtgaaattagagtcaatgggaatttatcagattctggccatctactcaacagttgcgagctcgttagtgctgcttgtctcactgggcgcgattagtttttggatgtgcagtaatgggtccctccagtgtcgcatctgcatt

SEQ ID NO: 403 - DNA, 1695 bp, Influenza A virus
  misc_feature (1)..(1695): Codon Optimized Sequence Encoding H1 Hemagglutinin
atgaaggccaacttgctggtgttactatgtgctctcgccgccgccgatgccgatactatttgcattggctatcacgccaacaatagtacggacaccgtggacactgtcctggaaaaaaatgtcaccgtcacccattctgtgaatctcctagaggattctcataacggcaagctgtgccggcttaaaggaatcgctcccttgcagcttgggaagtgcaatatcgccggctggctccttggaaacccggagtgtgatccattgctccctgtcagaagctggagctatatcgttgagaccccgaacagtgagaatggcatctgttaccccggagatttcattgattacgaggagctgcgcgaacagctcagctcagtctctagtttcgagcgatttgagatcttccccaaggagtctagctggccaaatcataacaccaacggagtgacagccgcctgtagccatgaagggaaaagcagcttctaccgaaatttgctgtggctaactgagaaagaggggagttatcctaagctcaaaaacagctatgtgaacaagaaggggaaagaagtcctggtgttgtggggcatccaccatcccccaaatagcaaggaacagcagaacctttaccagaacgagaatgcatacgtgagcgtcgtaacatccaattataacagacggttcacacccgagatagccgaacggccaaaagtgagggaccaggccggaaggatgaattactattggactctcttaaagccaggcgacaccattatatttgaggcaaacggaaacttgattgcgccaatgtacgcattcgcactgtcacggggattcggatccgggattatcacgtccaatgcatcgatgcatgagtgcaacaccaagtgtcagaccccactgggagccatcaattccagcttgccctatcagaacattcaccccgtgactataggagagtgccctaaatatgtccgcagcgccaaactgcgaatggttaccggcctgcgcaacaatccttcgatccagtcacggggcctgttcggggccatagctggcttcattgaggggggatggaccggtatgattgatgggtggtacggctaccaccatcagaacgagcagggttcaggctacgcggctgaccagaaatccactcagaacgctatcaatggcatcacaaacaaggtcaatactgttatagaaaaaatgaatatccaattcactgctgtgggtaaagagtttaacaagctggagaaaagaatggaaaatctgaacaaaaaagtggatgacggcttcttggatatctggacatacaacgctgaacttctggtgctgttggaaaacgaaaggactctggatttccacgattccaacgtgaaaaatctctacgaaaaagttaagtcccaactgaagaataacgcgaaggagatcggaaacggatgctttgagttctatcataagtgtgataatgagtgtatggaatcagttagaaacggtacgtacgattacccaaaatactccgaagagtctaagctgaatcgcgagaaagtcgatggggtcaaactcgaatccatgggaatttaccagatcttagctatttacagtacagtggccagctctcttgtcttactggtgtcacttggcgcgattagtttctggatgtgctccaatggcagcctccagtgtcggatttgcata

SEQ ID NO: 404 - DNA, 1695 bp, Influenza A virus
  misc_feature (1)..(1695): Codon Optimized Sequence Encoding H1 Hemagglutinin
atgaaggccaacctgcttgtactgctatgcgccttggctgctgcagacgccgacacaatttgcatcggctatcatgccaacaattctacagatacagtggacactgtgctggagaaaaacgttactgtcactcatagcgttaatctcctcgaggactctcacaatggaaaactctgtcgtctgaaaggcatcgcgccactgcagttgggtaaatgtaatatcgccggctggttgttgggcaaccccgaatgtgaccccctcctcccagtgaggtcctggtcttatatcgtagagacacctaattcggagaatggaatttgttaccctggcgacttcatagactatgaggaactgagggagcagctttcttctgtgagttcttttgaaagatttgagatcttccctaaagaatcatcttggcccaaccataataccaacggcgttacagcagcctgttcccacgagggcaagtcgagtttctacaggaatttgttatggctgactgagaaagaggggtcttatccaaagctgaaaaacagctatgtcaacaagaaaggcaaagaggttttggtgctgtggggaatccatcacccaccaaactcgaaggaacagcaaaatctttaccaaaacgaaaatgcatacgtatcagtggttactagcaattataatcggcgctttacgccagagattgccgaaagacctaaggtgagagaccaagcaggaaggatgaattactactggacactactgaaaccaggcgatactatcatttttgaggccaacggaaacctgatcgcacccatgtacgccttcgcactgtcgcggggttttgggtctggcatcatcacctcaaatgccagcatgcatgagtgcaatactaaatgccaaacacctttaggtgccattaatagctcactcccctaccagaacatccatccagtaactatcggggagtgtcccaagtacgtgcgatctgcaaaactgaggatggtcactggtttgcgcaacaatccctctatccagtcaaggggcctatttggcgcaattgcgggctttatcgagggagggtggacgggtatgattgacggatggtacggctaccaccaccagaatgaacagggttcggggtacgcggcagatcagaagagtactcagaacgcaattaatggtataactaataaggtcaacaccgtaattgaaaaaatgaatatccaattcacagctgttgggaaagaatttaacaaactggagaagaggatggagaatctcaataagaaggttgatgacggctttctcgatatctggacttacaatgctgagctgctagttctgctcgagaacgaacggacactcgattttcacgattccaacgttaaaaacctgtacgaaaaggtcaaatctcagctgaagaataatgctaaggaaattggtaatggctgtttcgaattttatcataaatgtgataatgagtgcatggaaagtgtccgtaacggcacctacgattatccaaagtatagcgaggaaagcaagcttaatcgtgaaaaagtagatggcgtgaagctggaaagtatgggcatatatcagatcctggccatatacagtactgttgcctccagtctagttttactggtatccctcggagctatctcattctggatgtgtagcaatggcagccttcagtgccgtatctgtata

SEQ ID NO: 405 - DNA, 1695 bp, Influenza A virus
  misc_feature (1)..(1695): Codon Optimized Sequence Encoding H1 Hemagglutinin
atgaaagctaacctgctagttctactttgtgcccttgccgctgccgacgctgacaccatctgcatagggtaccacgctaacaacagtactgacacagtggataccgttcttgaaaagaacgtcaccgtaactcactctgtgaatttgctcgaggattcacacaatgggaaactctgcagactgaaaggaattgctccacttcagttgggcaagtgtaacatcgctggctggctgcttgggaatccggagtgcgacccattgctgcctgtgcgcagttggagctacattgtggagacccccaacagcgagaatggcatctgttatcccggagatttcatcgactacgaggagctccgagaacaattatcctctgtgtctagtttcgaacggtttgagatctttcccaaagaatcaagctggcccaaccacaacacaaacggtgtgacagcagcatgcagtcatgagggcaagtcgtccttctataggaatctgctgtggcttactgagaaggagggtagctacccgaaactcaagaactcctacgtcaataagaagggcaaagaggtgttagtcttgtggggaatacaccacccacccaactctaaagagcaacaaaacctgtaccagaacgaaaacgcctacgtctccgtagtaacctcaaattataacagacgctttacgcccgagatcgcagagcgccccaaggtcagggaccaggcagggagaatgaactactattggactttgttgaagcccggagacacaattatcttcgaggcgaatggcaatctgattgcccccatgtacgcttttgcactgtcccgcggttttggttccggcatcataacttccaacgcatcgatgcacgaatgtaacaccaaatgtcagacaccattgggcgccataaactccagtctcccatatcaaaatatccacccagtcacaatcggggaatgtcctaaatacgtgaggtcagcaaagcttaggatggtcacgggactgcgcaacaatccctcaatacagtccagagggcttttcggagccatagccggcttcatcgaaggcggctggactgggatgatcgatggctggtatgggtatcatcaccagaatgagcagggctccggctatgctgccgatcagaaatccacacagaacgctatcaatgggataactaacaaagttaacaccgtgattgagaagatgaacatacaatttactgcagtgggaaaggagttcaacaaactggagaagcggatggagaacttaaataaaaaggtggatgacggcttcctggacatctggacttataacgctgaactgttggtactgcttgagaatgagcggaccctcgactttcacgactcaaacgtgaagaatctctatgagaaggtaaaatcccagttgaaaaacaacgccaaggagatcgggaatggctgctttgaattttaccacaagtgcgacaatgagtgtatggaaagtgtgcgcaacggaacatatgactatcctaaatatagtgaagagtccaaactgaaccgtgaaaaggtggatggggtgaaactcgagtccatgggaatctaccaaatcctcgccatttattcaaccgtggcaagcagcctcgtgctactggtcagtctcggcgcgatttctttctggatgtgctccaacgggtcactgcagtgtcgcatatgcatc

SEQ ID NO: 406 - DNA, 1695 bp, Influenza A virus
  misc_feature (1)..(1695): Codon Optimized Sequence Encoding H1 Hemagglutinin
atgaaggcgaacctccttgtgcttctctgcgctctcgcagctgctgatgcagacacgatttgcatagggtatcatgcaaacaatagtacagacactgtggacaccgtgctggagaaaaacgtgactgtcacgcactcagttaatcttttggaggactcccataatggaaaactgtgcagacttaaggggatcgcacccctgcagttaggcaagtgtaatatagccgggtggcttctggggaacccagaatgtgacccactgttacctgtgcgaagctggtcttacatagtggagacgccaaattctgagaacggcatctgttaccctggggactttattgattatgaggaactccgggaacaactctcgagcgttagcagcttcgaaaggtttgaaatttttcccaaggaatcttcatggcctaaccacaacactaacggtgtgacggctgcttgctcacatgagggaaagtccagtttctataggaacctgttgtggctgactgagaaagaaggcagctacccaaagctgaagaactcttacgttaacaaaaaaggcaaggaagtgttagtactgtggggtatccaccacccaccaaacagcaaggagcagcagaacttgtaccagaacgaaaatgcctacgtcagtgttgtcacatcaaactacaatagaagatttacgccagaaattgccgaaaggccaaaggtgcgggaccaagctgggcggatgaactattattggacccttctgaagccgggagacacgatcatattcgaagcaaacgggaatctgatcgctccgatgtacgccttcgcactcagccggggttttggatcagggatcatcacatctaacgcctctatgcatgaatgtaacacgaagtgccagactcctctaggcgctatcaactctagcttaccctaccagaatatacatcccgtcaccatcggcgagtgtcctaagtatgtgcgcagcgccaaactgcggatggtgactggcctgagaaataatccgtccatccagtcaagagggctgtttggagcaatcgccggcttcattgaagggggctggacaggtatgattgatggttggtacggataccaccatcagaatgaacaggggagtggctacgcagcagatcaaaagtcgacacaaaacgcgataaacggaatcacaaacaaggtcaataccgtgattgaaaagatgaatattcagttcaccgccgtcggcaaagaatttaacaagcttgagaaacgtatggaaaatctcaataagaaagttgacgacggtttcttagacatctggacctataacgcagaactgctggtgctactggaaaacgagagaacccttgatttccatgatagcaacgtgaaaaacctttacgagaaagttaagagtcagctcaaaaacaatgctaaagaaatcggaaacggctgcttcgagttttatcataagtgcgacaatgagtgtatggagagtgttcgaaacgggacatatgattacccgaagtattcagaggagagcaaactcaatcgcgaaaaagttgatggtgtgaagctggaatctatgggcatctaccagatactggccatctactcaacagtggcaagttctctggtattgctcgtttccctgggagctatctccttctggatgtgttcgaacggctcacttcagtgtaggatttgcata

SEQ ID NO: 407 - DNA, 1695 bp, Influenza A virus
  misc_feature (1)..(1695): Codon Optimized Sequence Encoding H1 Hemagglutinin
atgaaggccaacctgttggttctcttgtgtgctctggcagccgcagacgctgacactatttgtatcggataccacgccaataatagtactgacaccgttgacacagtacttgagaagaacgtgacagtaacccactcagtgaacctccttgaggatagccacaatggaaaattatgtagacttaagggtatcgctcccctccagctgggcaaatgtaatattgccggctggctactggggaatccggaatgtgatcctctcctgccagtccgatcatggagttatatagtagaaactccaaatagcgagaatggaatttgttaccccggcgattttattgactacgaagagctccgagaacagctcagttcagtgtcttcattcgaacggtttgaaatcttcccaaaagaatcctcatggcccaatcacaacactaacggggtcacggcagcatgcagccacgaagggaagtcgtctttctaccgaaatctcctgtggctgaccgagaaagagggttcgtaccccaagctcaagaattcttacgttaacaagaaggggaaggaagtacttgtgctgtggggtatacaccatccacctaattccaaagagcagcagaacctgtatcaaaacgaaaatgcatacgtcagcgtggttacaagtaactacaacaggcgctttaccccagagatcgccgagaggcctaaggttcgggatcaggccgggagaatgaactactattggactctcctcaagcccggtgacacaataatcttcgaggccaatggaaatcttatagcaccgatgtatgccttcgcactgtcacgcgggtttggctcaggcattataacatctaacgctagtatgcatgagtgcaataccaagtgccagaccccactgggtgcaatcaacagctccttgccttaccagaacatacacccagtcactattggcgagtgcccgaaatacgtacgctctgccaagctgcgtatggtcaccggactccgcaataaccccagtatccaaagccgaggtttgtttggcgctattgctggattcattgaaggaggctggacgggaatgattgacgggtggtacggctatcatcatcagaatgagcaagggtcaggttacgccgccgaccagaagagtacacagaatgcaatcaacggaataaccaataaggtcaacaccgtcatcgaaaagatgaatatccagttcacggcagtgggaaaggaattcaataagctagaaaaacgcatggagaatctcaacaagaaggttgacgatgggtttctggatatctggacatacaacgctgagctgcttgtgctgctggagaacgagaggacactggacttccacgactctaatgtcaagaatctttatgaaaaagtcaaatcccagctcaaaaataatgcaaaggagatcggaaatggctgcttcgaattctaccacaagtgtgacaacgagtgcatggagtctgtgcggaacggaacctacgactatccaaagtattctgaggaatcaaaactcaatcgagagaaagttgatggggtaaaactggaatctatggggatttaccagatcctggccatctactccacagtggctagttccttggttctgttggtgtctctaggtgcgatctccttctggatgtgttccaatgggagtcttcaatgtcgaatctgcata

SEQ ID NO: 408 - DNA, 1695 bp, Influenza A virus
  misc_feature (1)..(1695): Codon Optimized Sequence Encoding H1 Hemagglutinin
atgaaggcaaatttgcttgttttactgtgtgctttggctgcggctgatgccgacaccatatgcatcggttaccacgctaataacagcaccgacacagtggatacggtgctggagaaaaatgtgaccgtaactcacagtgtgaacctgcttgaggacagccacaacggtaagctctgccgtctgaaaggaatcgccccgctgcaattgggaaagtgcaacattgctggctggctcctgggtaatcctgagtgtgacccgctgctgcccgtgcgaagctggtcctacatcgtggagactccaaactcagagaacgggatctgttaccctggagattttatagactatgaagagctaagggaacaattgtcgtctgtcagttcctttgaacggttcgagattttcccaaaggagtccagttggcctaatcataataccaatggtgtcactgctgcatgtagtcacgaaggcaagtcctcattttatcggaatttgctgtggctgactgagaaggagggcagctatccgaagttgaagaattcatacgttaataaaaaaggtaaggaagtgcttgtcctttggggcattcatcatccccctaacagtaaggaacagcagaatctctaccagaacgagaacgcatacgtgtccgtggttactagtaattacaataggaggttcacaccagagattgcggaacggcctaaagtccgggatcaggccggtagaatgaactattattggactttgctgaaacccggagacacaatcatattcgaagctaatggtaacctgattgctcctatgtacgcattcgctctgtcccgtggcttcggctccgggattatcacctctaatgctagcatgcacgagtgtaacaccaaatgccagaccccactcggggcgattaacagcagcctcccataccagaacattcatcccgttactataggcgagtgcccaaaatatgttcggtctgcaaaactgcggatggtgacggggctgcgaaataacccttcaatacagagtagggggctgttcggagcaatagctggttttattgagggcggatggactggcatgatcgatggctggtatggataccatcaccaaaacgagcaaggatctggttatgcagcggaccagaagtcaactcagaatgccattaacggcattactaataaagttaataccgttattgaaaagatgaacattcagtttaccgccgtagggaaggagtttaacaagcttgaaaagcgcatggagaacctcaacaagaaagtggatgatgggttccttgacatctggacatataacgccgaattactagtgcttttggaaaacgaaagaacactggatttccatgactccaatgtgaagaatttatatgaaaaggtcaaaagtcagctcaagaataatgcaaaggaaatcggcaatggttgcttcgaattttaccataagtgtgacaacgagtgtatggagagtgtaaggaatgggacatacgattacccaaagtatagcgaggaatcaaagctgaacagagagaaagtggacggcgtgaaattggagtccatggggatctaccagattctggcgatctatagcaccgtcgccagcagcttggtcttgctggtatctctcggggccatttccttttggatgtgttcaaatgggagcctccaatgtagaatctgtatc

SEQ ID NO: 409 - DNA, 1695 bp, Influenza A virus
  misc_feature (1)..(1695): Codon Optimized Sequence Encoding H1 Hemagglutinin
atgaaagccaatctactggtgttgctctgtgccctggctgctgccgatgctgacacgatatgtatcggctaccacgcaaacaactccaccgatacagttgataccgtgctcgaaaagaatgtcaccgtaacacatagcgtgaaccttttggaggattcgcacaacggtaagctgtgtcgtttaaagggcatcgcccctcttcagctgggaaaatgcaatattgcgggctggttgctcggtaaccccgagtgtgaccctctgctccccgtgcgtagttggtcatatattgtggagacacccaatagcgagaatggaatttgttaccccggggactttatcgattacgaagagctgcgggaacaactgtctagtgtcagctcgttcgaacgctttgagattttcccaaaagagagctcctggcccaaccataacactaacggggtgactgctgcctgttcccatgaggggaagtctagtttttaccgaaatctgctgtggctaacggagaaagagggctcttatccaaagctaaagaatagttacgtaaacaagaaaggaaaagaggtgctcgttctctggggcattcatcacccaccaaactccaaggagcagcagaatctgtatcagaatgaaaacgcctacgtatccgtggtgacaagcaactacaacaggcgattcacgcccgagatcgccgagcggcctaaagtgagggatcaggctggcaggatgaactactattggacgctgctgaagccaggggatactattatttttgaggcgaacggaaacttaattgcccccatgtacgcatttgcgctctccagaggattcggctctggaatcatcacgtcaaacgctagcatgcacgagtgtaatacaaagtgtcagaccccactgggggcaatcaatagcagcttaccttaccaaaacatccatccagtgactatcggtgaatgcccgaagtacgtaaggtccgcaaagctgagaatggtgacgggcctcagaaataaccctagtatacagagtcgtggcctgtttggggccattgctggatttatcgaaggagggtggaccggaatgatagacggctggtatggctaccaccaccagaatgagcagggatctgggtacgctgctgatcagaagagcacgcagaacgccattaacggcataaccaacaaggtgaatacagtcatcgaaaaaatgaacatacagtttacagcagttgggaaagaattcaacaaactggagaagaggatggaaaacttgaacaaaaaagtcgatgacgggtttctcgacatctggacttacaacgccgagctgcttgtgttactggagaacgaaaggacactcgactttcacgactctaacgtgaagaatctttatgagaaagtgaaaagccaactgaaaaacaatgccaaagaaattggtaacggctgcttcgagttttaccataagtgtgacaacgagtgtatggaatcagtccgcaacggtacctacgactatccaaaatactctgaagaatcaaagctgaatagggagaaggtggacggcgttaaattggagagcatgggcatttatcaaatccttgccatttattcgacagtggcctcctctttagtgctcttagtgtccctgggcgccatcagtttctggatgtgtagtaacggctcactccaatgtcgaatttgcatt

SEQ ID NO: 410 - DNA, 1695 bp, Influenza A virus
  misc_feature (1)..(1695): Codon Optimized Sequence Encoding H1 Hemagglutinin
atgaaagcgaacctcctggttttattgtgcgcacttgccgctgctgatgcagacaccatctgtattgggtatcacgcgaacaattcgaccgacacggtcgatacagtgcttgagaaaaatgtgactgtaacacattccgtgaatctcctcgaagacagccataacgggaagctttgcaggcttaaggggattgcaccgctgcagctcgggaaatgtaatatagccgggtggctattagggaacccggagtgcgaccctttgcttccagtgaggtcctggtcatatattgtcgagaccccaaattcagaaaacgggatctgttaccccggcgacttcattgactacgaagagctgagggaacaattaagttctgtctcctcttttgaacggtttgagatattcccaaaagagtcctcctggcccaatcataacacgaatggcgtgacagctgcgtgtagccatgaagggaagagcagtttctacaggaatcttctttggttaacagaaaaagaaggtagttatccgaaactgaaaaacagctacgtaaataaaaaaggcaaggaggtcctggtgttgtggggcattcatcaccctcccaatagcaaggaacagcagaatctctatcagaatgaaaacgcctatgtcagcgttgttactagcaactacaaccggcggtttacccccgaaattgctgagcgacccaaagttcgcgatcaggccggtcggatgaattactactggacccttctgaagcctggcgacaccattatttttgaggccaacggcaacctaattgccccaatgtatgcattcgccctgagccgaggttttggaagtggcataatcacgtccaatgcctctatgcacgaatgcaacaccaagtgccagacaccccttggcgctatcaactcttctctaccttatcagaacatccatcccgttactattggggagtgccccaaatacgtccggtctgctaaacttcggatggtgacaggcctccgcaataatccttcgattcaaagtcggggcctgtttggtgcaatcgccgggttcattgagggagggtggactggcatgatcgacggttggtatgggtaccaccatcagaacgaacaaggcagtgggtacgctgccgatcagaaaagcacccagaatgctatcaacggcattacgaacaaggtgaacactgtgatagagaagatgaacatccagttcactgctgtcggtaaagagtttaacaaacttgaaaaaagaatggagaacctcaataaaaaggtggacgatggtttcctggatatatggacatataacgccgaactacttgtgctcttggaaaatgaacggacactggacttccacgactctaatgtgaaaaatttatatgagaaagtgaagtcacagctcaagaataacgcgaaggaaattggcaacgggtgtttcgagttctatcataagtgcgacaatgagtgcatggaatcagttcgaaatggaacctatgactatccaaagtactcagaagagagtaaactgaaccgggagaaagtcgacggagtcaagctcgaatctatgggtatttatcagattctggccatctacagcacagtcgcttcttctcttgtactgctggtttctttgggcgcaatctctttctggatgtgctcaaacgggagcctgcagtgccggatctgcatc

SEQ ID NO: 411 - DNA, 1695 bp, Influenza A virus
  misc_feature (1)..(1695): Codon Optimized Sequence Encoding H1 Hemagglutinin
atgaaggctaatctgttagtacttttatgtgcacttgccgcagctgacgcggatacgatctgcattgggtaccatgccaacaacagtaccgacaccgtcgataccgttttggaaaagaatgtgaccgtgacccacagcgtcaaccttctcgaggatagtcacaatgggaaactctgtcggctgaaaggcatagctcctctgcagctcggaaaatgtaacatcgccggctggttattggggaaccccgaatgcgatcccctcctcccagtaaggtcttggtcctatatcgtggaaacacctaacagcgagaatggcatctgctaccccggggacttcattgattacgaagaactaagagaacaactgtcgagtgtgagtagtttcgaaagatttgaaatattccctaaggagtcaagttggcccaatcacaacacgaacggcgttacggcagcgtgctcccatgaagggaaatcaagcttctatagaaatctgctctggctaacagaaaaggagggctcatacccaaagttgaagaactcctacgtcaataaaaaaggtaaggaagtattggtcctgtgggggatccatcaccccccaaattcgaaagagcaacagaacctttatcagaatgagaatgcttacgttagcgtagttacgagcaactataatcggcgattcacacccgagattgctgagagacctaaggtgagagatcaggcaggtcggatgaactactactggactcttctaaagcccggcgatactataatctttgaggctaacggcaatctgattgcccctatgtatgctttcgcattgtccagaggttttgggagtgggatcatcacgagcaatgccagtatgcatgagtgtaacactaaatgtcagacacccttaggggctatcaacagttctcttccctatcagaatatccacccagtaaccatcggagaatgccctaaatacgtcagatctgcaaaactcaggatggtgactggcctcagaaataaccccagtatacagagcagaggtttattcggggcgatcgctggctttatagaaggaggctggacgggcatgattgacggctggtatggctatcatcatcagaatgaacagggcagcggttacgcagccgaccagaagagcacacaaaacgctattaacggaatcaccaacaaggtgaatacagtcattgaaaaaatgaatattcaattcactgcagtcggaaaggaattcaacaaactggaaaaaaggatggagaatctcaacaaaaaagtcgacgacgggttcctggatatctggacatacaatgccgaactcctcgtcctgctcgagaatgagcggacccttgatttccacgattccaatgtcaagaacctttacgagaaggtgaaatcccagttaaagaataacgccaaagagattggcaatgggtgcttcgaattttatcacaagtgcgacaacgagtgtatggaaagcgtcagaaatggcacctacgactatcctaaatattcagaagagtctaaactgaatagggaaaaagtcgacggcgtcaagcttgagtctatggggatatatcagattcttgcgatttattcaactgtcgcatcctccctcgttctgctcgtgtccctgggcgcaatctcattctggatgtgctctaatggttcattgcagtgtcgcatctgtatc

SEQ ID NO: 412 - DNA, 1695 bp, Influenza A virus
  misc_feature (1)..(1695): Codon Optimized Sequence Encoding H1 Hemagglutinin
atgaaggcaaacctgctggttcttctgtgtgcattagccgcggccgacgccgatacaatatgtatcggataccacgcaaataacagcaccgacaccgttgacacagtgcttgagaaaaacgtgaccgtgacacacagtgtgaatctgctagaggactcccataacgggaagctgtgccggttgaagggaatcgctccgctgcagttgggcaaatgcaatattgctgggtggctgttaggtaaccctgaatgcgatccactcctccctgtacgttcttggtcgtatatagtggaaactcccaatagcgaaaatggtatttgttatcctggggatttcatagattacgaagagctgcgcgaacagctcagctctgtgagctctttcgagcgcttcgaaatattccccaaggagtccagttggcccaaccacaataccaacggcgttaccgcagcctgtagccacgagggcaagtccagcttttaccgcaacctcttgtggttgaccgaaaaggagggaagctatccgaaactcaagaacagctacgtcaataaaaaaggcaaggaggtactagtgctgtggggcatccaccaccctccaaatagtaaagagcagcagaatctgtatcagaacgaaaacgcgtatgtctcagttgtgacaagcaattacaaccgcaggttcactccggagatagctgaaagacccaaagtacgggatcaggctgggcgaatgaactactactggacactactcaaaccaggtgacaccattattttcgaagcaaatggcaatttgatcgcacccatgtacgcatttgccttgtcccgggggttcggctccggcattattacgtctaacgcatctatgcacgagtgcaacacgaaatgccagactcccctgggggccataaactcaagcctgccatatcagaacatccacccggtcaccatcggcgagtgccccaaatacgtccgctcagctaaactcaggatggtcacgggcctcagaaataatcctagcattcagtctcgcggtctgtttggcgccatcgcaggcttcattgaagggggctggaccggaatgatcgatgggtggtacgggtatcatcaccagaacgagcaaggcagtggctatgctgccgatcagaaatcaacccagaatgcgattaacggaataactaacaaggtgaacaccgtcattgagaagatgaatattcagttcacggccgtcggaaaggagtttaacaagctcgaaaagcgcatggagaacctgaacaagaaggtagatgatggcttcctggacatttggacctacaatgctgagctcctcgtcttgctggagaatgaacggactctcgacttccacgattccaacgttaagaatttatatgagaaagtgaagagtcaacttaaaaacaacgcgaaggaaatcggtaatggctgctttgagttctaccataagtgtgataacgagtgtatggaaagcgtgcgaaatgggacttatgactaccctaagtattcggaagaatctaaactgaatagagagaaggtggatggggtgaagctcgaatctatggggatttaccagatcttggctatctattcgacagtggcttccagtcttgtcctactggtgtctcttggcgccatttccttctggatgtgctccaacggatctctgcagtgccgcatctgtata

SEQ ID NO: 413 - DNA, 1695 bp, Influenza A virus
  misc_feature (1)..(1695): Codon Optimized Sequence Encoding H1 Hemagglutinin
atgaaggcaaatttgttagtcttgttgtgcgctctggccgctgcagatgcagacaccatctgtatcgggtatcacgcaaataattccacagatacagtggacaccgttctcgagaaaaacgtcaccgtgacccatagcgtgaaccttctcgaggactctcacaacggtaaattatgcaggcttaagggaatagctcccctgcaacttggtaagtgcaatatagcaggatggctcctgggcaacccagaatgtgacccgctactgccagtgaggagctggtcttacatcgtcgaaacgcctaactccgaaaacgggatctgttatcctggcgatttcattgattatgaagagttacgggagcagttatcaagcgtgtcgagcttcgaaaggtttgagatcttccctaaggagtcaagttggccgaaccacaacacgaatggcgtcacagccgcatgttcccatgaagggaagtcctctttctatcggaatcttttgtggctaacggagaaggagggatcctatcctaagcttaaaaactcctacgtaaacaaaaagggcaaggaggtcttagtactgtggggcatacaccacccacctaactcaaaggagcagcagaacctttatcagaatgaaaatgcttacgtctcggtggtgaccagcaactacaacagacgcttcacgccggaaattgccgagagaccaaaggtaagggatcaagccggtcgaatgaattactattggaccttattgaaacccggggacaccatcatatttgaagctaacggcaatttgatcgctccaatgtacgcgtttgccctttcccgcgggttcggttctgggatcataacctctaacgcttccatgcatgaatgtaacacaaagtgccagactccattaggggccattaatagcagtttaccttatcaaaatatccacccagtcactatcggagagtgcccaaaatacgtgaggagcgcgaaattgaggatggtgacaggccttcggaacaatccctctatccagagcagaggactgtttggcgcaattgctgggtttatagaggggggatggaccggcatgattgacggatggtacggataccatcatcagaatgagcagggaagtggatatgctgcagaccaaaagtcaactcagaatgctattaatggtatcaccaacaaggtgaacacagtcatagaaaagatgaacatccagtttaccgccgttgggaaggaatttaacaagctggaaaaaaggatggagaatctcaataaaaaggtagacgatgggttccttgatatttggacttacaatgctgagctgttagtcctactagaaaatgagagaacccttgactttcacgactccaacgttaaaaacttatacgagaaagtgaaatcccaattaaagaataacgcgaaagagatcggcaacgggtgtttcgaattctatcacaaatgcgacaacgaatgcatggagtctgtgaggaatgggacttatgattatcccaagtattcagaggagtctaaactgaatcgagaaaaagtggacggagtaaagctggagtccatgggcatatatcaaatcctcgccatctattccacagtcgcctcctcccttgttttgttggtttcccttggtgcgatcagtttttggatgtgctctaacgggtccctacagtgccgaatttgtatt

SEQ ID NO: 414 - DNA, 1695 bp, Influenza A virus
  misc_feature (1)..(1695): Codon Optimized Sequence Encoding H1 Hemagglutinin
atgaaagctaatcttctcgtgctactgtgcgccttagcagctgccgacgctgataccatctgtataggctatcatgccaataactccacagacaccgttgatactgtgcttgagaagaatgtgacggtaacccacagcgttaatctccttgaggacagccataatggcaaactgtgtcggctgaagggaatcgctcccctacaattgggaaaatgcaacattgcaggatggttgttaggaaacccagaatgcgaccctctactgccagtgcgcagctggagttacattgttgaaacacctaacagcgaaaatggtatttgctaccctggggatttcatagattacgaggagttaagagagcagctgtccagtgtgtcttccttcgaaaggtttgaaatcttcccaaaggagtcctcatggcccaaccacaacacgaatggcgtcacagctgcctgttcacacgagggtaagtcaagtttttataggaacttgctttggttaaccgaaaaagagggaagctacccaaagctgaaaaatagctacgtgaataaaaagggcaaagaggtgctggtgctatggggtatccatcatccgccaaacagcaaagagcagcaaaacctgtaccagaacgaaaatgcctacgtgtctgttgtgacgagcaactacaaccgtagatttaccccggaaatcgcagagcggccgaaggtgcgcgatcaggcgggacgtatgaattactattggacattgcttaagcccggagacacaattattttcgaagctaacgggaatctcattgccccaatgtatgctttcgcactgagccgaggctttgggagcggcatcatcacaagtaatgctagcatgcatgagtgcaataccaagtgtcaaacgcctctgggcgcaatcaattccagtttaccatatcagaacattcatccagtcaccatcggggagtgccctaaatatgtaaggtctgctaaactgcggatggtcactggtctccgcaacaatccatctatccagagccggggtttgttcggagctattgctggatttatagaggggggctggacggggatgattgatggctggtacggctatcaccatcagaacgaacagggcagcggctacgctgcagaccaaaaaagtactcagaacgctattaatggcattaccaacaaggttaacactgtgattgagaagatgaacatccagttcactgcggtaggaaaggaattcaacaaacttgagaagcggatggaaaatctcaacaagaaggtagacgatgggttcctagatatatggacctataatgccgagctcttggtcttgttagaaaacgagcggaccttagacttccatgatagcaacgtgaaaaacctgtacgagaaagtgaagagccagttaaagaataacgctaaggaaatcggaaacgggtgctttgagttctaccataagtgtgacaatgagtgtatggaatctgtgcgtaacgggacctacgactaccccaaatattctgaggaatcaaaactaaatcgagagaaggtagacggcgtgaagttagaatctatgggtatctatcaaatcctggctatatactcaaccgtggcctcatccctagttctcctggtatccctcggcgccatctctttctggatgtgcagcaacggctctctccagtgtcgcatttgcatc

SEQ ID NO: 415 - DNA, 1695 bp, Influenza A virus
  misc_feature (1)..(1695): Codon Optimized Sequence Encoding H1 Hemagglutinin
atgaaggccaatttgctggtgttgttgtgtgctctggcagcagccgatgctgacactatctgcatcggctaccatgccaacaatagtaccgatactgtggacactgtgttagagaagaacgtgacagtcactcactcagtaaacttgctggaggatagccataatggcaaactctgtcgcctcaagggcatcgcccctctgcagctgggaaaatgcaacattgctggatggctgctggggaacccggaatgcgacccgctgctccccgtgagatcctggagttatatagttgaaactcccaacagtgagaacgggatatgttatcctggcgacttcattgactacgaggagctgcgcgaacagctctctagcgtatcttcgtttgaacgtttcgaaatatttcccaaggaatcttcttggccaaatcacaataccaacggagtcacggcggcctgctcgcacgaggggaagagttccttttatcgcaacctactgtggctcaccgagaaggagggttcctaccccaagctgaaaaacagctatgtgaacaaaaaaggcaaagaagtcttggtactgtggggcattcatcacccacccaacagcaaggaacagcagaacctgtatcaaaatgaaaatgcttacgtctccgttgtgacatcaaactacaacagacggttcacccctgaaattgctgagaggcctaaggtcagggaccaggccgggcggatgaattactactggacactgctgaagccgggagacacgattatcttcgaagcaaacggcaatctgatcgccccaatgtacgcgtttgctctttctcggggatttggctctgggatcattacctctaatgcatccatgcacgaatgcaacaccaaatgtcagaccccactaggcgctattaatagttccctgccctatcagaatatccacccggtgaccatcggcgaatgtcctaaatatgtgcggagtgccaagctgaggatggtcactggcttacgtaacaatccctcaattcagagccggggcctctttggagcaatcgctggattcatcgaggggggttggaccggaatgatcgacggctggtacggatatcatcaccagaatgaacaagggtctggctacgccgccgaccaaaaatctacccaaaacgctattaatgggattaccaataaggtgaacactgtaatagaaaaaatgaatattcagtttactgccgttggaaaggaattcaataagctggagaaacgtatggagaatctgaacaagaaggtagatgacggattcctggacatctggacctataatgcagaattgctcgttctgcttgaaaatgagcgcacactggactttcatgactctaacgtcaaaaatctgtatgaaaaggtcaagtcccagctgaaaaataatgcgaaagagattgggaacggatgtttcgaattctaccacaagtgtgacaacgaatgcatggagtccgtacggaacggcacgtacgactacccaaaatattctgaggaaagcaagctgaatagagaaaaggtcgatggggtgaaactggagagtatgggaatctatcagattctcgccatctactccactgtcgccagctccttggtacttcttgttagcttgggagccatatcattctggatgtgctccaatggatccctccaatgcagaatctgcatc

SEQ ID NO: 416 - DNA, 1695 bp, Influenza A virus
  misc_feature (1)..(1695): Codon Optimized Sequence Encoding H1 Hemagglutinin
atgaaagctaaccttttggtgctgctctgtgccctggcagctgccgatgccgataccatctgtatcggctaccatgctaataatagtacagacacagtggacaccgttctggagaaaaatgtcaccgtgacacatagcgtgaacttgctggaggattctcacaacgggaagctgtgccgtctgaaagggattgcccctcttcagctcggtaaatgcaacatcgccgggtggctgctaggcaatccagagtgtgatcccctgctgccggtgagaagctggagctacatcgtggagacacccaactccgaaaatggcatttgctaccccggcgatttcatcgactacgaagaactgcgggagcagctgtcgtctgtgagctccttcgagagattcgagatctttccaaaagaaagcagttggcccaatcacaataccaacggcgtgaccgctgcatgtagtcacgagggcaagagctcattctatagaaacctgttgtggctgacagagaaggaggggagctatcccaaactgaagaattcctatgtgaataaaaaggggaaggaggttctggtattatggggcatccatcatcctcctaacagcaaagagcagcaaaacctttatcagaacgagaatgcctatgtatcggttgttaccagcaattataatcggaggtttaccccagagatagctgagcgtccaaaagtgagagaccaagctggccggatgaattactattggaccctcctcaaaccgggcgataccatcattttcgaagccaatggcaacttaatagcgcccatgtatgcttttgccctttcgaggggatttggatcaggtatcatcacaagcaacgcatcaatgcacgagtgtaacactaagtgtcagactccactcggggcaattaacagcagcctaccttaccagaacatccaccccgtgacgattggagagtgtcccaagtacgtaaggtcagccaagctcaggatggttacagggctgcgaaataacccctctattcagtcaaggggcttgttcggcgccatcgccgggtttatcgagggcggctggaccggaatgatcgacggatggtatggctaccatcaccagaacgaacaagggtctggctatgctgcggatcagaagtcaacacagaatgctataaatggtatcacgaataaggtaaatacagtcattgaaaagatgaatatccagtttacggccgttgggaaggagttcaacaagcttgaaaagagaatggaaaatctgaataaaaaagtggacgacggctttttggatatctggacatataacgcggagctgctagtgctcctggaaaacgagcggactcttgactttcacgattccaacgtcaagaacctctatgaaaaggttaaatcacaattgaagaataatgctaaggagattggcaatgggtgctttgagttctaccataagtgtgacaacgaatgtatggagtcagtccggaacggtacttacgattaccccaagtattcggaagagtcaaagttgaatagagaaaaagtcgacggcgtgaaactcgagtctatgggcatttaccagatccttgcgatttatagcaccgtcgccagtagcttggtactcctagtatctctgggtgcaatctccttttggatgtgttctaacggcagcttacagtgcaggatctgcatt

SEQ ID NO: 417 - DNA, 1695 bp, Influenza A virus
  misc_feature (1)..(1695): Codon Optimized Sequence Encoding H1 Hemagglutinin
atgaaagctaacttgcttgtgttgttgtgcgctttggccgctgccgacgccgacactatttgcatcgggtatcacgccaataattccacagataccgtcgataccgtgctcgagaagaacgtgaccgtcactcactcagtgaaccttctggaggactcccataacgggaagctctgtaggttgaaaggaatcgccccactgcagcttggtaaatgcaatatagccggttggctgctgggaaaccctgagtgcgacccactcctccccgtacggtcttggagctacatcgtggagacgccaaattccgagaatggaatctgttatcccggcgactttatcgattatgaggagttgcgcgagcagctgagttcagtttcatcctttgaacggttcgagatttttccaaaagagtctagctggcctaatcataataccaatggggttacagccgcttgctcacatgaggggaagtccagtttctataggaacctgctttggctgaccgagaaagagggctcctatccaaagctcaagaacagctatgtaaataagaaaggcaaggaagtgttggtcctgtggggcatacaccaccctcccaactcgaaggagcagcaaaacctataccagaacgagaatgcctacgtcagcgtggtcactagcaattacaatagaaggttcacacccgaaattgctgagcggccgaaagtgagagaccaggcaggacgaatgaactactattggaccctgctgaagcccggggatacaatcattttcgaggcgaacgggaacctcattgcccccatgtacgcttttgccctcagcagaggctttgggtctggtataatcaccagtaacgctagcatgcatgaatgtaataccaagtgccagacacccttaggggccattaactcatctctcccatatcagaacatacatcctgtgaccatcggtgaatgcccgaaatacgtaaggagcgcaaaattaaggatggtgaccggtcttaggaacaatccatccattcagtctcgagggcttttcggcgccattgctggattcatagaaggcggatggacaggcatgatcgatggatggtacggttatcaccaccagaatgagcaggggtcgggctacgctgccgatcagaagtctacccaaaatgccatcaatggcataaccaacaaggtgaacacagttatcgagaaaatgaacatacagtttactgcagtgggaaaggagttcaacaaactggagaaacgaatggagaacttgaataaaaaagtcgacgacggcttccttgatatttggacttataatgccgagcttttagtcctgttagagaatgaacgtacattggacttccacgatagcaacgtaaagaacctctatgagaaagtgaaaagtcagctaaaaaataatgccaaagagatcgggaatggttgtttcgagttttatcacaagtgtgataatgagtgcatggagtctgtgagaaacggcacgtacgattaccctaagtattctgaggagagtaagttaaatcgcgagaaagttgatggtgtgaagcttgagtcaatgggcatctaccagatcctggccatctactccaccgtggcgtcttctctggtgctgcttgttagcctgggtgctatctccttctggatgtgttctaacggctccctgcagtgtaggatctgcatc

SEQ ID NO: 418 - DNA, 1695 bp, Influenza A virus
  misc_feature (1)..(1695): Codon Optimized Sequence Encoding H1 Hemagglutinin
atgaaagcaaatctgctggtgttgctgtgtgccctggctgccgcagacgcagataccatctgtatcggctatcacgctaataacagtacagacactgtggatactgttctcgagaagaacgtcactgtgacccactcagtaaatttactcgaagacagtcacaacggcaagttgtgtagactcaaaggcattgcccctctccagctgggaaagtgcaacattgctggatggctcctggggaaccccgaatgtgatccgcttttgcctgtgagaagctggtcctacatagtagaaaccccaaactccgaaaatggtatttgctatccgggcgattttatagattatgaagaattaagggagcagttgtcttccgtgtcctccttcgaacgcttcgaaatcttccccaaagagagttcctggccaaaccataatactaacggggtgacagcggcttgctctcacgaaggaaaatcttccttctaccggaacctgctttggttgaccgagaaggagggcagttacccgaaattgaaaaatagttacgttaataagaaagggaaggaagtcctggtgttatggggtattcatcaccccccaaacagcaaggagcagcaaaatttgtaccagaacgagaatgcgtacgtgagtgtggtcaccagtaattacaaccggaggtttacccccgagatcgcagaacgcccgaaagtacgggaccaggcagggaggatgaattactattggactcttttaaagcccggggataccatcatctttgaggcaaacggtaacctcatagctcccatgtacgccttcgccctgagccgcggtttcggcagtggcattataacctctaacgccagcatgcacgaatgtaacactaaatgtcagacccctctcggcgccattaatagcagtctcccttaccaaaatatccaccccgttaccattggcgagtgtccaaaatacgtaaggtccgcaaaactgcgcatggtgactggactgagaaacaatccctctattcagtcgaggggactattcggagccatcgctgggtttatcgaagggggatggactggaatgatcgatggttggtacgggtaccaccaccagaacgagcaaggctcagggtatgccgcagaccagaagagtacccagaacgccatcaacggtatcactaataaggtgaataccgtcatcgagaagatgaatatccagtttaccgctgtgggcaaagagtttaataagctggaaaagcgcatggagaacctgaataagaaggttgacgacggcttcctcgatatttggacttataacgccgagctgctcgttctcctcgaaaatgaacgcacccttgactttcacgattcaaacgtcaagaatctgtatgagaaggtgaagagccagctgaagaataacgcgaaggaaatcgggaacggttgtttcgaattttaccacaagtgcgataatgagtgcatggagagcgtgcgaaatggcacatatgactatcctaagtacagcgaggaaagtaaactcaacagagaaaaggttgatggcgtcaagctcgagtcaatggggatttaccagattctggccatctatagtactgtggcttcctctctggttttgctcgtttcactgggagccatttctttctggatgtgttcgaacggatccctccaatgcaggatttgtatt

SEQ ID NO: 419 - DNA, 1695 bp, Influenza A virus
  misc_feature (1)..(1695): Codon Optimized Sequence Encoding H1 Hemagglutinin
atgaaagcaaatctgctcgtcctcctgtgcgctcttgcagccgccgacgccgacaccatatgcattggatatcatgctaacaactcaacagacaccgtggacactgtcctagaaaaaaacgtgaccgtgacacactcggtcaatctgttagaagacagccataacgggaagctgtgccgactcaagggaatagcccccctgcagctgggcaagtgcaatatcgccgggtggctcctcggcaaccctgagtgcgatcccttgcttccagttagaagttggtcctatatcgtcgaaactcctaactcagagaatggaatttgctatcccggagatttcatcgactacgaagagctcagagagcaactttccagtgtgtcaagtttcgaacgctttgaaatcttcccaaaggaatcttcatggcccaaccacaatacgaatggagtgaccgccgcctgtagtcacgagggaaaaagtagcttctaccgcaatcttttgtggctgaccgagaaggaaggaagctacccaaagctgaagaactcctacgtgaacaaaaaaggtaaggaggtcctggtgctgtgggggattcaccatccccctaacagtaaggagcagcaaaatctctaccagaacgagaacgcttacgtatctgttgtgacttctaattataacaggaggttcacgccagaaattgctgagaggccaaaggtcagggaccaggctgggcgcatgaactactactggaccctgctaaagcctggtgacactatcatctttgaggccaatggaaatttaattgcacccatgtacgcatttgccctatcgcgcgggttcgggagcgggataattacctccaacgcatcgatgcatgagtgcaacacaaaatgtcaaacacctctcggggccattaacagctccctcccctatcagaatattcacccggtaacaatcggtgaatgtcctaagtacgtacgctccgccaagctgaggatggtaaccggtctgcggaataatcctagcatccagtcccggggtcttttcggcgccatcgcaggttttatagaagggggctggactggtatgatcgatggatggtacgggtaccatcaccaaaatgagcaaggttcggggtacgcagcagaccagaaatcaacccaaaatgccattaacggaattacaaataaggttaacaccgttatcgaaaagatgaatatccagtttacagccgtagggaaagaatttaataagctcgagaagcggatggaaaacctgaacaagaaagtggatgacgggttccttgacatctggacttataatgcagagctattagtgctgctggagaacgaacgtaccctggatttccatgattcaaacgtcaaaaatctttatgagaaagttaagtcccagctcaagaataatgcgaaggaaatcggcaacgggtgtttcgaattctatcacaagtgcgataacgaatgcatggagagcgttagaaacggcacctatgactaccccaagtacagcgaagagtctaagctgaaccgggaaaaggtcgacggtgtgaaactggaatccatgggcatttaccagatcctcgctatttactcgacagtcgcaagtagcctggtgcttttggtttctctcggcgcaatctcattctggatgtgctccaacggatccctccagtgtcgcatctgtatc

SEQ ID NO: 420 - DNA, 1695 bp, Influenza A virus
  misc_feature (1)..(1695): Codon Optimized Sequence Encoding H1 Hemagglutinin
atgaaagctaacctgctggtccttctgtgcgctctcgcagcagcagatgcggacaccatctgcataggataccatgctaataattccacagacactgtggacacagtgctggaaaagaatgtaacggtgacccacagcgttaacttgctggaggatagccacaatggtaagctttgtcgtttgaaagggatcgcacccctgcagttgggcaaatgtaatatcgccgggtggctcctgggcaacccggagtgcgaccctttgctgcccgtgcggagttggtcatacattgtggaaactcctaacagtgagaatggtatttgctatcctggggacttcattgactatgaagaacttcgcgaacagttatctagcgtgtctagctttgaacgctttgagatcttcccaaaggagagtagttggcctaaccataacaccaacggggtcacagcggcctgttcgcacgaaggcaagtccagcttttatcgcaatctgctgtggttgacagagaaggagggatcatacccgaagctgaaaaattcctacgtgaacaagaagggcaaagaagtactggtgttatggggcattcaccacccaccaaatagcaaagagcagcagaacctttatcagaacgagaacgcctacgtgagcgttgttacgagtaattacaaccgccgatttactcccgagattgcggaaaggccgaaggtgagagaccaggcaggccgcatgaactattactggacactcctgaagcctggtgacacaataatcttcgaagctaacggcaacctgatagccccaatgtacgcctttgccctaagtagaggtttcggctctggaattattacgtctaacgccagcatgcacgagtgtaacactaaatgccaaaccccactaggtgctattaactcgtctctgccgtaccagaatatccacccagtaacgattggagagtgccctaaatatgtgcgatcagcaaagcttagaatggtgactgggttacgcaacaatccctctattcagtcccgcggcctgtttggggcgatagccggattcatcgaagggggctggacgggcatgattgacggctggtatgggtatcatcatcagaacgaacagggatcaggatacgcagctgaccaaaaatccacgcagaacgccatcaacgggatcacgaataaagtgaatacagtgatcgagaaaatgaacattcagttcacggcagttggaaaagagttcaacaaacttgagaagaggatggagaacctgaataaaaaggtggacgacggattcctggatatatggacttacaatgccgaactactcgtcctactggaaaatgagcgaacgctggacttccatgattcgaatgtcaagaatctgtatgaaaaggtcaagtcccagctgaaaaataatgctaaagagataggcaacgggtgtttcgagttttaccataagtgcgataatgaatgtatggagtccgtgcgaaacggtacttacgactacccaaaatactcagaggagtccaaactcaacagggagaaagtggacggggttaagctggaaagtatgggtatttatcagatcctggccatctattctacagttgcatcttctctagtgctgctggtatctctgggcgcaatatctttttggatgtgttcaaatgggagcctgcagtgccggatttgtatc

SEQ ID NO: 421 - DNA, 1695 bp, Influenza A virus
  misc_feature (1)..(1695): Codon Optimized Sequence Encoding H1 Hemagglutinin
atgaaagcaaatcttctggtgttactgtgtgctttggcagcagccgatgctgacaccatatgtattggctatcacgcaaacaattcaaccgacacagtcgacaccgtcctcgaaaagaacgttaccgtgacccactcagtgaacctcctcgaggactcccataatggcaagctgtgtaggttaaaggggatcgccccactgcagttgggaaagtgtaatattgctgggtggcttctgggtaaccccgaatgcgatccactcctccccgttcgcagctggagttacattgttgaaaccccaaacagcgagaacggtatctgttacccaggagattttattgattacgaggagttacgagaacaactgtcctcagtgagttcttttgaaaggtttgagatattccctaaagagagcagctggccgaatcataacaccaatggggtgactgcagcttgctcccacgaggggaagtcctccttctatcgcaatctgttgtggctcaccgaaaaggagggatcatatccgaagttgaaaaatagctacgttaataagaagggaaaagaggtgctggtgctgtggggaatccatcatccacctaattccaaggagcaacagaatctataccaaaacgaaaatgcttacgtttctgtggtgacctcaaattataaccgccgcttcactccagagatcgctgagcgaccaaaagtgcgggaccaagccggcagaatgaattactattggaccttgctgaaacccggagacaccataatttttgaagccaatgggaacctgattgcccctatgtacgccttcgccctgtctaggggtttcggcagcgggatcataacatctaacgcaagcatgcacgaatgtaataccaagtgtcagacccctctgggagccattaattccagtctcccataccagaacatccaccccgttaccattggggagtgtccgaaatacgttagaagtgccaaattacgaatggtgacaggattgcggaacaaccccagcatccagagcagaggcctatttggcgccatcgcaggattcatcgaaggcggatggaccggaatgatcgacggatggtacgggtatcaccaccagaatgaacaggggtcgggttacgccgccgaccagaaatctacccagaatgccattaatgggataacaaacaaggtcaacaccgtgattgagaagatgaatatacagtttactgccgtcggcaaagagtttaataaactggaaaagcgaatggaaaacctgaacaagaaagtcgacgatgggttcctggatatctggacatacaacgctgagttgctcgtgctgctcgagaatgagagaaccttggactttcacgattcaaacgtaaaaaacttatacgaaaaagtcaagagtcagctgaaaaataatgccaaggaaatcgggaacggatgctttgagttctatcacaagtgcgacaatgagtgtatggaatccgttaggaacgggacatacgattacccaaaatactccgaggagagcaagttaaacagagaaaaagttgacggagtgaaactagagtccatgggtatttaccagatcctggccatttattctaccgtcgcgtcatcactggtactccttgtctcccttggagcgatatccttctggatgtgttccaacggctcccttcagtgccgaatctgcatt

SEQ ID NO: 422 - DNA, 1695 bp, Influenza A virus
  misc_feature (1)..(1695): Codon Optimized Sequence Encoding H1 Hemagglutinin
atgaaggctaatcttctggtgttactgtgcgccctggctgccgccgacgccgacaccatctgcattggttatcacgctaataactcgacggatacagtggatactgtactggaaaagaacgtgacagtcacccacagtgttaacctgctcgaggatagtcacaatggcaagttgtgcaggctgaaggggatcgctcccctgcaactcggcaagtgtaatatcgccggctggcttttaggcaaccccgagtgcgaccccctactgcccgttaggtcctggagctacatcgtggaaactcctaacagcgagaacggcatctgctatcctggggacttcatcgattacgaagagctccgggaacagctctcttccgtgagctcctttgagagatttgagatcttccctaaggaatcgtcctggcctaaccacaatacaaatggcgtgacagctgcctgttcacacgaagggaaaagttccttctataggaatctgctgtggctgacagagaaagagggctcttatcctaaattaaagaactcctacgtgaacaagaagggtaaagaggtcttagtgctgtggggcattcaccatccccccaattccaaggagcagcaaaatctgtaccagaacgagaacgcttatgtgtccgtcgttacttctaactataataggcgtttcaccccggagattgctgagaggcctaaggtacgggaccaggccggtagaatgaattactactggacactacttaagccaggtgacacaatcatctttgaggcaaacggaaacctaatcgctccaatgtatgcatttgccctgagccgcggattcggtagcggaattatcaccagcaatgcctctatgcacgagtgcaatactaagtgtcagactcctttgggagcgatcaactccagcttgccataccaaaacattcacccggtgactattggtgaatgccccaagtacgtgcggtctgcaaaactgagaatggttaccggactccggaataaccctagtatacagtctagggggctctttggagccattgcaggtttcatcgaaggcggctggaccggcatgatcgacggatggtatggttatcaccaccaaaacgagcagggatcaggatatgctgcagatcaaaaatctactcaaaatgcaataaacggtatcaccaataaggtgaacaccgtaatcgaaaaaatgaacatccagtttacagccgtgggcaaggagtttaataagctggagaaacgcatggagaacctcaataagaaggttgacgatggattcctggacatctggacgtataatgccgagctcctggtactgctcgagaatgaacgaaccctcgacttccatgatagcaacgtgaagaacttatatgagaaggtgaagtcacaactgaaaaacaatgctaaggaaataggcaacggatgttttgaattctaccacaagtgtgacaacgaatgtatggaatcggtgaggaatgggacatatgactaccccaagtactcggaagaaagtaagcttaatagggagaaggtggacggcgtgaaactcgagagcatggggatttaccaaatcctagcaatctattccacagttgcttcttctctggtgctccttgtgtcacttggggcgatttcgttctggatgtgctcaaacgggagcctccagtgccggatctgcatc

SEQ ID NO: 423 - DNA, 1695 bp, Influenza A virus
  misc_feature (1)..(1695): Codon Optimized Sequence Encoding H1 Hemagglutinin
atgaaggcaaacctgctggtcctgctctgcgcactggccgcggcagacgccgacacaatctgcataggctatcacgcaaataacagtactgacaccgtcgatacagtcctggagaaaaacgtgactgtgacccacagcgtaaatctgctggaagacagccacaatggaaaattgtgcagattgaaaggaatagcacccctgcaattggggaaatgtaatattgccggatggctgctcggcaaccccgaatgcgacccgctgctgcccgtccggtcttggagttatatcgttgagacaccgaactccgagaatggtatctgctatccgggcgacttcatcgactatgaggaactcagagagcagctgtcatctgtgtcttcattcgagcgtttcgagattttcccaaaggagtcatcgtggcccaaccataacacaaacggagtcacggcagcatgctctcacgaagggaaaagctctttctaccgcaacctgctctggttgactgagaaagaggggtcttaccccaaacttaagaacagctacgtgaacaagaagggcaaggaggtcttggtactgtggggcatccatcacccacctaatagtaaagagcaacaaaacctataccagaacgagaacgcatacgtgtcagtagtcacctctaattacaacaggcggtttacaccagagatagctgagcggccaaaggtccgggaccaggcaggcaggatgaactactattggactttgttaaagcctggagacaccatcatctttgaggctaacgggaatctgattgctcccatgtatgcttttgcactttccagaggctttggatccggtattatcacatcgaatgcgtccatgcatgagtgtaacactaagtgtcaaacaccactcggcgcaatcaattcttcacttccttatcaaaatattcaccccgtgaccatcggcgagtgccccaagtatgtcaggagcgctaagctgcggatggtgacagggttgaggaataatccttcaattcagtcgaggggattattcggtgccatcgcgggattcattgagggggggtggacaggaatgatagacgggtggtatggttaccaccatcagaacgagcaggggtcaggctacgccgctgaccaaaaatccacccaaaatgccatcaatggaatcacaaataaggtaaatacagtgatcgaaaaaatgaacattcaattcacagctgtcggaaaggagttcaataagcttgagaaacgaatggagaacttaaataaaaaagttgacgacggtttcctggacatttggacatacaacgcagaactgctcgttttactagagaacgaacggacgctggactttcatgattctaacgtaaagaacttgtacgagaaggtgaaaagccagcttaaaaataacgccaaagaaatcggaaacggctgcttcgaattctaccacaaatgtgataacgagtgcatggagagcgtgaggaatgggacatatgactatcccaaatattctgaagagtcaaaactgaatcgggaaaaggtcgatggtgtcaaactggagtctatgggcatctatcagatactggcaatctactccaccgtggccagcagtctcgtgctgctggtgagcctgggcgcaataagcttctggatgtgctcaaacggaagcctgcaatgtaggatttgtatc

SEQ ID NO: 424 - DNA, 1695 bp, Influenza A virus
  misc_feature (1)..(1695): Codon Optimized Sequence Encoding H1 Hemagglutinin
atgaaggccaatctcctggtgctgttgtgcgcactggcagcggcggatgcagatacaatatgtatcggatatcacgcaaataacagcacagatacagtggacaccgtgctggagaagaatgtgactgtgacgcatagtgttaacctcttggaagatagccacaatggcaagctgtgtcgcttgaagggaatcgcccccctgcagctcgggaaatgcaatatcgcgggatggcttctgggtaaccctgaatgcgacccgctgctgcccgtgcgctcatggtcatacattgtggagacacctaattcagagaatgggatttgctatcctggggactttatcgattacgaggaactgagagagcagctatcttcagttagttccttcgaacgattcgagatctttccaaaggagagtagctggcccaatcataacactaacggagtgaccgccgcgtgcagccacgagggcaaatcctcattttaccgaaacctgttatggctcacagaaaaggaggggtcttacccgaagctgaaaaactcttatgtgaacaagaaggggaaagaggtgttagttctgtggggcattcaccaccctccaaattccaaggaacaacaaaacctttaccaaaacgagaatgcatatgtctcggtcgtgacgtcgaactataatagaagatttacccccgagattgctgaacgacccaaggtgagagatcaggcgggaagaatgaactattactggaccttgctcaaaccgggagatacaatcatattcgaggctaacggaaacttgatcgccccaatgtacgcctttgccctctcccgcggtttcgggagcggtatcatcacctcaaatgcttctatgcatgaatgcaataccaaatgtcaaacacctctgggcgcaatcaactcgagcctgccttatcagaacattcaccctgtcaccattggtgagtgccccaagtacgtaagatcagctaagctgcgtatggtgaccgggctgagaaacaatccctccatccaaagtcgcggtttattcggcgccattgccgggttcatagagggtgggtggacaggaatgatcgatggctggtatggatatcatcatcagaacgaacaaggatcagggtatgcagcagaccagaagtctactcaaaacgcaattaatggcatcaccaataaggttaacactgtcatagaaaagatgaacatccagttcactgcggtgggcaaagagtttaacaagctcgagaagcggatggagaacctcaataagaaagtcgatgacggattcctggatatatggacatataatgccgagctgctggtgctgctggaaaacgaaagaaccctcgatttccacgactctaatgtgaagaatctgtacgagaaggtcaagtcccagctgaaaaataacgccaaggagatagggaacggctgctttgaattctatcacaagtgcgacaatgagtgcatggagagcgttcggaacgggacttacgattatccgaagtattcagaggagagcaagcttaatcgtgaaaaggtcgacggagtgaaattagaaagtatgggaatctatcagattcttgcaatctatagcaccgttgccagctctctggtgttactggtaagcctcggggcaatatctttttggatgtgtagcaatgggtctctccagtgtcgaatttgtatt

SEQ ID NO: 425 - DNA, 1695 bp, Influenza A virus
  misc_feature (1)..(1695): Codon Optimized Sequence Encoding H1 Hemagglutinin
atgaaggccaacctgctcgtgcttctgtgtgcgctggccgccgccgacgcagacactatctgtatcggctatcacgccaataacagcacggataccgtggataccgtattggagaaaaatgtcacggtaacacactctgtgaatctgcttgaagactcccataacggaaaactttgtcggctcaagggcattgcccctctgcaactgggcaagtgcaacatcgccgggtggctgctgggcaatccggagtgcgaccctctcctgccagtcaggtcctggtcctatatcgtagaaacccccaatagtgaaaacggcatatgctacccaggtgatttcatcgattatgaagagctcagagagcaactgagctccgtcagcagttttgagcggttcgagattttcccaaaggaatcatcatggccgaatcacaacaccaatggagtgaccgcagcgtgttctcatgaggggaagagctcgttctatcggaacctgctttggttgacggagaaggaggggtcataccccaaacttaagaactcatacgtgaataaaaagggcaaggaggtcctcgtgctgtgggggattcaccacccccccaattccaaggagcagcagaatctgtaccaaaacgagaatgcttatgtgagtgtggtgacgtctaattataatagacggtttacacctgagatcgcagaaagacccaaagtgcgcgaccaggctgggaggatgaattactattggactctgttaaagcccggcgataccatcattttcgaggcaaatgggaatcttatcgctccaatgtacgccttcgccctgtcacgggggttcgggagcgggattatcacatcaaatgccagcatgcatgaatgcaacactaagtgccagaccccactgggcgccatcaattccagcctcccttaccagaacatacaccctgttacaataggagagtgccccaagtacgtccgatccgctaaactgcggatggttacaggcctacgtaataatcctagcattcagtcacggggactgtttggcgcaatagccgggttcatcgagggcgggtggaccggaatgattgatgggtggtacggataccaccatcagaatgagcagggatctgggtacgccgccgaccagaagagcacacagaatgccattaatggcataaccaacaaagtgaacaccgtgatcgagaagatgaacattcaatttacggctgtaggtaaggaattcaacaaactggagaaacggatggagaatttgaacaagaaggtcgatgatgggttcctcgatatttggacctacaacgctgagcttttggtgctgctggagaacgagaggacacttgattttcatgattcgaatgtgaaaaacttgtacgaaaaggtcaagtcacagctgaagaacaacgctaaagagattggaaatggatgcttcgagttttatcacaaatgcgacaatgaatgtatggagagtgtgcggaacggaacatacgattaccccaaatattccgaggagtctaagcttaaccgtgagaaggtcgatggcgttaagttagagtccatgggaatctaccagatcctggctatatatagcaccgtcgcaagctctctagtcttgctcgtctcactgggagcaatctcgttttggatgtgctctaacgggtccctacagtgtcggatttgcatc

SEQ ID NO: 426 - DNA, 1695 bp, Influenza A virus
  misc_feature (1)..(1695): Codon Optimized Sequence Encoding H1 Hemagglutinin
atgaaagctaatctgctggtcctgttgtgtgcactggcggctgcagatgcggataccatttgtatcggttatcacgctaataactctactgacacagtcgacacggtgttggaaaagaacgtcacagtcacccacagcgtcaatctgctcgaagattcacacaacggaaagctatgtaggttaaagggtattgcaccattgcaactgggaaagtgtaacattgctggatggctgctggggaaccccgagtgtgatcctttgctccctgtcagatcctggtcctacattgtggaaacccctaactcagagaacgggatctgctatccaggagattttatcgactatgaagagctgagggaacaactatccagcgtctccagctttgagaggttcgagatattccctaaggagtcaagctggccaaatcacaatacaaacggtgtcacagccgcctgcagtcacgaaggcaagtcatcgttctaccgaaatttgttgtggttgacggaaaaagagggatcatacccaaaactcaagaatagctatgtcaacaagaaaggcaaggaagtgcttgtcctctggggcatacatcatcctcctaactctaaggagcagcaaaacttataccagaacgagaacgcctatgtgagtgtggtcaccagcaattataatcgcaggttcacgcctgagattgccgagaggccaaaagtcagagaccaggccggcaggatgaattactattggacattactgaaaccaggcgatactattatcttcgaggctaacggaaatctgatagcaccaatgtacgcctttgccttgtcccgtgggttcggctctgggatcataacatccaacgcaagcatgcatgagtgcaacacaaagtgccagacaccgcttggagccattaattcttctctgccatatcagaacattcatcctgtaacaatcggggaatgcccaaagtacgttagaagtgccaagctgcgcatggtgaccggcctgaggaataatccctctattcagtccagaggactgttcggagccatcgctgggtttattgagggcggctggaccggaatgatagatggctggtacgggtaccaccaccagaatgaacagggctctggctatgccgcggaccagaaatctacccaaaatgccatcaatggaatcaccaataaagttaacacggtgattgagaaaatgaacattcaatttaccgcggtaggaaaggagtttaataagcttgagaagcgtatggagaatttgaacaagaaggtggatgacggtttcctcgatatttggacctataatgccgaactactagttttattggagaacgaacgcacactggatttccacgactctaatgttaaaaatctgtacgagaaagtgaagtcacagctaaagaataatgccaaggaaataggaaatggatgctttgaattttaccacaaatgtgacaacgaatgcatggaatctgtgcggaatggaacttacgattaccctaagtactctgaggagagtaaactgaacagagagaaggtagacggcgtaaagctcgaatcaatgggaatctaccaaattctggccatctactctaccgtcgcctcctctctggttttattggtctctcttggagccattagtttctggatgtgcagtaacggctccctgcagtgcaggatttgtatc

SEQ ID NO: 427 - DNA, 1695 bp, Influenza A virus
  misc_feature (1)..(1695): Codon Optimized Sequence Encoding H1 Hemagglutinin
atgaaggccaacctcctcgtgctgctctgcgccttggcagccgcagacgccgataccatctgtatagggtaccacgccaacaattcaacagataccgtcgataccgtactggagaaaaacgtcaccgtcacgcacagcgttaacctgttggaagatagtcataatggaaagctctgtcgcctaaaaggaatcgcgcctctgcagctgggaaagtgcaacatagccgggtggctcctcgggaacccggagtgtgaccctcttttgccggtgcgctcatggtcatatattgttgagacccctaacagcgaaaacggaatatgttacccaggggacttcatcgattatgaggaattacgagaacaactaagttccgtctcttccttcgagcgctttgaaatctttcctaaagagagttcctggcccaaccacaacactaatggcgtgacagctgcttgcagtcatgagggcaaaagttcattctatagaaatcttctctggctaactgagaaagaaggatcctaccctaaactcaaaaattcctatgttaacaagaagggcaaagaggtgctcgtgctgtgggggatccaccacccaccaaattcaaaagagcaacaaaacctctaccagaatgaaaatgcctacgtgagcgttgtgacttcaaattacaatagacggtttaccccagagatcgcagaacgccctaaggtacgtgatcaggctgggcgaatgaactactactggacactcctcaaaccaggcgacactataatcttcgaggctaacggcaacctgattgctccaatgtacgcgttcgctctttcacgcggattcggctccggcatcattactagtaatgcatctatgcatgaatgcaatactaagtgccagaccccactcggagccataaacagttctctgccatatcagaacatacaccctgtgactataggagaatgcccaaaatatgttcggtccgctaagctgcgcatggtgaccggactccggaacaacccatccatacaatcacgggggctgtttggcgccattgccggcttcatcgagggtggatggactggtatgatcgatggttggtatggataccatcatcagaatgaacagggctccggctatgccgccgatcagaagtccacccagaacgccattaacggaattaccaacaaggttaatactgtgatcgagaagatgaatattcagttcacagcagtcgggaaggaattcaacaaactggagaaacgtatggaaaatctcaacaagaaggtggacgatgggtttttagacatttggacttataatgccgaactgctggtgctgctggaaaacgagagaacgttggactttcacgacagcaacgtgaaaaacctgtatgaaaaagtgaagtcccagctcaaaaacaatgcaaaggaaatcggcaacggttgctttgagttctaccataagtgcgacaacgaatgtatggaatctgtgcgcaatggaacctacgactatcctaagtatagcgaagaatctaaattaaatagggaaaaggttgatggagtgaaactggagtctatggggatctaccagatccttgctatctactcaaccgtcgctagctccctcgtactgctggtcagtttaggagcgatatctttctggatgtgttctaatgggtcactgcagtgtagaatttgcatc

SEQ ID NO: 428 - DNA, 1695 bp, Influenza A virus
  misc_feature (1)..(1695): Codon Optimized Sequence Encoding H1 Hemagglutinin
atgaaggccaatctgctggtgcttctctgcgccttagccgccgccgatgcagataccatttgtattggatatcacgctaacaacagtacagatactgtggacactgtcctggaaaagaacgtcaccgtcacgcatagcgtaaacctgctcgaggactcacacaacgggaagctctgtcgtctgaagggcatcgcccccctgcagctcggcaaatgcaacattgcgggatggcttcttggaaaccccgagtgtgatcccttattaccagtgcgctcttggtcctatatagtagaaaccccaaacagcgagaacgggatttgttaccccggcgatttcatagactacgaggagttgcgcgaacagctgtctagcgtctcctcattcgaacgtttcgagattttcccaaaggaatcctcgtggcccaatcataataccaatggagtcactgccgcctgcagccacgagggaaagtcatctttctatcggaatctgctctggctgaccgaaaaggagggatcttatcctaaactgaaaaattcttacgtcaataagaaaggcaaggaagtcttagtattatggggaattcatcaccctcccaacagtaaggagcagcagaacctgtaccagaacgagaacgcctatgtttctgtcgtgacatctaactataacagacgtttcaccccagaaattgctgaaaggccaaaggtccgtgatcaggccggcaggatgaattactactggactcttctgaagcctggtgacacaatcattttcgaagccaacggcaacctgattgctcccatgtacgcgttcgctctgagtcgcggctttggatcgggtattattacgtccaatgcctctatgcatgaatgcaatactaaatgtcagacccctctaggcgccatcaattctagcctcccgtaccagaacattcatcctgtgactattggtgaatgcccaaagtacgtgaggtccgccaagcttcgcatggtgaccggcctgcgtaacaacccctccatccaatccagaggtctctttggggcaatcgccggttttattgagggtggttggaccggaatgatcgatggttggtacgggtaccaccatcagaatgagcagggcagtggatatgccgctgaccaaaaatctacacaaaacgcgatcaatggaatcaccaataaagtgaacacagtcatagaaaaaatgaacatccagtttactgcggtcgggaaggaatttaataagctcgagaaaagaatggaaaatctaaacaaaaaggtcgatgacggtttcctcgatatctggacatacaatgccgaattactggtcctgctcgagaatgagcggacattagacttccacgacagcaatgtaaagaacctttacgagaaggtgaagtcccagctgaagaacaatgctaaagagattgggaatggctgttttgaattttaccataaatgcgacaacgagtgtatggaaagcgtgcggaacgggacttacgattacccaaaatatagtgaggagagcaaattaaaccgtgagaaggtcgacggggtgaagttggaatccatgggcatttaccaaatcctcgcaatttactccaccgtggcttcttcattggttctcctggtgtcccttggggccatatcattttggatgtgctctaatgggagtctccagtgccgtatatgcatt

SEQ ID NO: 429 - DNA, 1695 bp, Influenza A virus
  misc_feature (1)..(1695): Codon Optimized Sequence Encoding H1 Hemagglutinin
atgaaggctaacctactggttctgctgtgtgcgcttgccgccgcagatgccgacaccatctgcatcgggtatcacgcaaataactccaccgacacagtagacacagtattggaaaaaaacgtgaccgtcacccactctgtgaacctgctcgaagatagccataatggcaaattgtgtagactcaaaggtatcgctcccttgcagctaggaaagtgcaacattgcaggatggctcctcggcaaccctgagtgtgaccccctcctgcccgtccgatcctggtcctacatcgtggagactccaaactcggagaacggaatatgttatcctggggatttcattgactatgaggagcttagggagcaactatccagcgtatctagtttcgaacggttcgagatctttccaaaagagtccagttggcctaaccataacacgaacggtgtgaccgctgcttgtagccatgaggggaaatcatctttctatcgcaacttgctttggctcacagagaaggagggctcctaccctaagttgaaaaacagctatgtcaataaaaaaggcaaagaggttctcgtgttatggggtattcaccaccctcctaactctaaagagcaacaaaatctgtatcagaacgagaatgcgtatgtgtcagtcgttacatcaaattacaataggcggtttacaccagagatcgctgaaagacctaaagttcgggaccaggccggccgcatgaattactactggactctgctgaagccaggggatacgattatctttgaagctaatggtaacctgattgctcccatgtacgcctttgccttatcaagaggatttggatccggcataatcacatccaatgctagcatgcacgagtgcaacaccaaatgccagactcctttgggagccatcaactctagtctgccatatcagaatatccatcctgtgaccatcggggagtgcccgaagtatgtgcgatcagccaagctgcggatggtcaccggattaagaaataacccctccattcagtctcgaggactgttcggtgctatcgctggttttattgaaggtggttggacaggcatgatcgatggctggtacggttatcaccaccagaacgaacaggggtctgggtacgctgccgatcagaagagtacccagaacgcgatcaatggcattaccaacaaagtgaacacagtaatagaaaagatgaacattcagttcaccgctgttggtaaagagttcaacaagctggaaaaacggatggagaatctcaacaaaaaggttgatgatgggttcctggatatctggacctacaacgcggaactgctggtactgctggaaaatgaacggacacttgactttcacgactctaacgtgaagaatctgtacgaaaaggtaaaatcacagctaaagaacaatgcaaaggagattgggaatggatgcttcgagttctaccataagtgcgacaacgagtgtatggagtctgtgcggaatggcacttacgattaccctaagtactccgaggaatctaaactgaatcgagagaaagtggatggtgtaaagctcgagagtatgggcatttatcagattctggctatctactcgactgtagcctcctcactggtgttactggtgagcctcggtgcaatctcattctggatgtgtagtaacggctccttacagtgtcgcatttgtatc

SEQ ID NO: 430 - DNA, 1695 bp, Influenza A virus
  misc_feature (1)..(1695): Codon Optimized Sequence Encoding H1 Hemagglutinin
atgaaggccaacttgttagtcctgctgtgcgctttagcggctgccgacgccgatacaatctgtattggctatcacgctaacaatagcactgacacagtcgatacagttctggagaagaatgttacagtcacgcatagcgtgaacttactggaagactctcacaatggcaagttgtgtcggctgaaggggatcgctccattgcaactcggaaaatgcaatatagcgggctggctgctcggaaatccagaatgtgatccccttctgcctgtccgctcctggtcctacatcgtggagactcctaattctgagaacggaatatgctaccctggcgacttcatcgactacgaagaactccgggaacagctctctagcgtgagttcctttgagagattcgaaatttttccaaaagagtccagctggcctaatcataatacaaacggcgtgactgctgcatgcagccacgaagggaaatcgtctttttatagaaatctgctgtggctgacggagaaagaaggatcatacccaaagctaaagaactcatatgttaacaagaaagggaaggaggtgctggtgctgtgggggatacatcacccacccaattctaaagagcagcagaacttgtatcagaacgaaaatgcctacgtgagcgtcgtgacttccaactataaccgaagattcactcccgaaattgccgaacgccccaaggtccgggatcaggcgggacgcatgaattactattggaccctgctgaaacctggagacactattatcttcgaggccaacggcaacttgatcgctcccatgtatgcctttgccctgagtcgaggttttggaagcgggattatcacttccaatgcatcaatgcatgaatgcaatacaaagtgtcagacaccccttggcgcaattaactcatctctgccctaccagaacattcatccagtcactatcggggagtgccctaaatatgttagatctgccaagctgcggatggtgacagggcttagaaataaccccagcattcagagccgcggcttgtttggagccattgctgggtttattgagggagggtggaccggaatgatagacggttggtacgggtaccatcatcagaatgagcagggcagtgggtacgccgctgaccaaaagagcacccagaacgctatcaacggaattaccaataaggtcaatacagtgatagaaaagatgaacattcagtttactgctgtggggaaggagttcaataaactggaaaaacggatggagaacctcaacaagaaagtggacgacggatttctggacatttggacctataacgccgagttactggtactgcttgaaaacgaaaggaccttagactttcatgattctaatgttaaaaatctgtatgaaaaggtcaagagccaacttaagaacaacgccaaagaaatcggaaacggttgcttcgagttttatcataagtgtgacaatgagtgcatggagtctgttcgaaatggtacatacgactatcccaagtatagtgaagagagcaaacttaatcgggagaaggtggatggcgtgaaactggaaagcatgggaatctaccagatcttagccatatacagtacagtcgcttcatctctcgtgcttctcgtcagcctcggagcaatcagcttttggatgtgtagcaacggcagcctccaatgccgaatctgcatc

SEQ ID NO: 431 - DNA, 1695 bp, Influenza A virus
  misc_feature (1)..(1695): Codon Optimized Sequence Encoding H1 Hemagglutinin
atgaaggcaaacctccttgtcctcctgtgtgcactggcagccgccgacgccgacactatttgtatcgggtaccatgcaaataactccaccgataccgtggacacagtcctggaaaaaaacgtgacagtgacgcattcagtgaatctccttgaagatagccacaatggaaagttgtgccggctgaaaggaatcgcacctttacagctgggaaagtgtaacattgcagggtggctgttggggaaccctgagtgtgaccccctcttacccgtccggtcttggagttacatagtggaaacaccaaatagtgagaacggcatctgctacccaggagatttcatcgattatgaagagctgcgtgaacaactctctagtgttagttctttcgaaaggttcgagatctttcctaaagaatcgtcatggcccaatcacaatacaaacggggtcacagctgcttgctcacacgaaggaaagagcagtttctatagaaatctgctgtggctgaccgagaaggagggttcttaccctaaacttaaaaattcttatgttaacaagaagggcaaagaagtgcttgtcctgtggggcatccaccatccccctaactctaaagagcagcagaacttgtaccagaatgagaacgcctatgtgtcagtggttacctcaaattataaccggagatttacgcctgagatcgccgagcggcccaaagtgcgggatcaagccggacgtatgaactactattggacactccttaagccaggcgataccattatctttgaggcaaatggcaacctgatcgcacccatgtacgcgttcgccttgtctcgaggattcggcagcggcatcatcacgtccaacgccagtatgcatgagtgtaatacaaaatgccaaactcccctcggggcaattaactcgtctctgccataccagaacatacatccagtgactattggtgaatgtcccaagtacgtccggtctgccaagctgcggatggtgactggcttgcgcaataaccctagcattcagtccagagggctgttcggcgcaatcgccgggttcatcgaggggggctggactggcatgatcgatggctggtatggatatcaccatcagaatgaacaggggagcggttatgcggccgatcagaaatcgacccagaacgcaatcaatggaattaccaacaaggttaacacagtcatagagaaaatgaacatccagttcacggccgttgggaaggagtttaataagttggaaaagcgaatggaaaacctgaataaaaaagtcgacgacggcttcctggatatctggacctataacgccgagctactcgttctgttggagaacgagaggacactcgacttccatgacagcaatgtgaaaaacctgtacgaaaaggtgaaaagtcagctcaagaacaatgcaaaagagatcggcaacggatgtttcgagttttaccacaagtgcgataatgagtgtatggaaagcgtgcgcaatggcacttatgactaccccaagtattctgaggagtccaaattgaatcgagaaaaggtggatggcgtcaagctagaatcgatggggatataccagatattggccatctactccaccgtggcctcctccctcgtccttcttgtttcgctgggcgccatctctttttggatgtgctcaaacggctcgcttcagtgtcgcatttgcatc

SEQ ID NO: 432 - DNA, 1695 bp, Influenza A virus
  misc_feature (1)..(1695): Codon Optimized Sequence Encoding H1 Hemagglutinin
atgaaggcaaacctgttagttctcctctgcgctttggctgcggccgacgccgacacaatctgtatcggttatcatgcgaacaactcaactgacacagtggatactgtgctggaaaaaaatgtgacagtcacccactctgtgaatctgctagaggactcacacaacggaaagctgtgcaggctcaagggcattgcgccactgcaattaggaaagtgtaacatcgctggatggctactgggaaaccccgagtgtgaccccctgcttcctgtgcgtagttggagttatatcgtcgaaactccaaacagcgaaaacggcatttgttatcccggcgatttcatcgattatgaggaattgcgggagcaactatctagcgtgtctagttttgagagattcgagatcttccctaaagagtcttcctggcccaatcataacacaaatggtgtcaccgcagcctgcagtcacgaggggaagagtagcttttatcgcaacctgctgtggctgaccgaaaaggaaggctcctatcctaaacttaagaacagctacgtgaacaaaaagggtaaggaggtccttgttctctggggaatccaccacccccctaatagcaaagagcagcaaaacctttatcagaatgagaacgcttatgtttctgtggtgacctcaaactataatagacgtttcacacctgaaatcgccgaaaggcccaaggttcgagatcaagccggtcgtatgaattactattggacgctgctaaagccaggcgacaccataattttcgaagcgaacggtaacttgatcgcccctatgtatgcattcgccctgtcacgtggctttggctctggtattatcaccagcaatgcctctatgcacgagtgtaatactaaatgtcagaccccactcggcgctatcaactcatccttgccctaccagaacatacatccagtgacaattggagaatgcccgaaatacgtgcgtagtgccaagctgagaatggtgactggtctccggaataacccctctatacagtccaggggcctgtttggggctattgccggttttattgagggaggttggactggcatgatcgatggatggtacggctatcaccaccagaacgagcaaggctctggctatgccgcagaccagaaatcaacacaaaacgctatcaatggaataactaacaaggtcaacacagtgattgaaaaaatgaacatccagtttacggctgtgggcaaggagttcaacaagctggaaaagaggatggaaaatctcaacaaaaaagtcgacgacggcttcttggacatctggacttacaatgcagagttgcttgttctgctggaaaacgaacgtacgctggacttccacgacagtaatgtcaagaatttgtatgaaaaagtgaaatcacagctgaaaaataatgcgaaggagataggcaatggctgttttgagttctatcataagtgcgataatgagtgcatggagtcagtgcgaaacgggacctacgactaccccaaatatagtgaagagagcaagctgaatagagagaaagtcgatggcgttaaacttgagagcatgggtatctatcaaatcctggctatttacagtacagtggcctcctctctagtgctgctcgtatctctcggagcgatatccttctggatgtgttccaatggctctctacagtgccggatatgcata

SEQ ID NO: 433 - DNA, 1695 bp, Influenza A virus
  misc_feature (1)..(1695): Codon Optimized Sequence Encoding H1 Hemagglutinin
atgaaagctaatctgcttgtactgctgtgcgcactggcagccgcagacgctgacactatctgtatcgggtaccacgccaacaattcgaccgatactgtggacacagtgttggagaagaacgtcaccgtaacgcacagcgtgaaccttttagaagatagtcataatggaaagctgtgtaggctcaagggaatcgctccacttcagttgggaaaatgcaatatcgctggctggctactgggcaaccctgaatgcgaccccctgctgcctgtgcgatcctggtcctatattgtagagacccccaactcagagaatggcatttgctacccaggcgattttattgactacgaggagctgagagagcagttgtcctccgtctccagctttgaaaggtttgagattttcccaaaagagtccagctggccaaatcacaatacaaatggtgtgaccgccgcttgttctcacgaaggcaaaagctccttctatagaaatcttctgtggctaacagaaaaagaaggatcatacccaaagttgaaaaacagctacgttaataagaaaggcaaagaggtgctggtcctgtggggtatccaccacccacccaattctaaagaacaacaaaatttgtaccaaaatgaaaacgcctacgtttctgtcgtcactagcaattataaccggaggttcacacccgagatcgcagaaagacctaaggtgagagaccaagccggcagaatgaattattactggactctcctcaaacccggggacaccatcatcttcgaagctaacggcaatctgattgctcctatgtacgcttttgctctgtcccgggggtttggcagcggtattatcacatcaaacgccagtatgcacgagtgtaatacgaaatgccagactcctctgggggctatcaattccagtctgccctatcagaatattcatcctgtcacgatcggtgagtgccctaagtatgtgcgaagcgccaaactgcggatggtaacgggcctgaggaataacccctctattcagtctcgcgggctgtttggcgcaatcgccggctttatcgagggcggttggactggcatgatcgacggatggtacgggtaccatcaccagaacgaacaggggtccggctacgccgccgaccagaaatcaacccagaacgcgattaacgggatcaccaacaaggtgaatactgtgattgagaagatgaatattcagtttacagcagtgggcaaggagtttaacaaacttgagaaacgcatggagaatctcaacaaaaaggttgacgatggattccttgatatttggacatataatgccgagctgctggtccttctggaaaatgaacgcacactggattttcacgactcgaacgtgaagaatctgtacgagaaggtaaagtcccaattaaaaaacaatgctaaggagataggcaacggctgcttcgagttttaccacaagtgcgataacgagtgcatggagtctgtgagaaacggtacgtacgattaccccaaatattccgaagagagcaagctcaaccgcgagaaagtagacggcgttaaactggagagcatgggcatctaccagatcctcgccatttactccactgtggcctcgtcactagttctcttggtgtccctgggagccatctcattttggatgtgctccaacggctcactacagtgccggatttgtatc

SEQ ID NO: 434 - DNA, 1695 bp, Influenza A virus
  misc_feature (1)..(1695): Codon Optimized Sequence Encoding H1 Hemagglutinin
atgaaggccaacctcctggtgttactttgtgccctagcagccgcagacgccgacactatctgcatcggataccatgctaataacagcaccgatacagtagataccgttttggaaaagaatgtcactgtcacccacagcgttaatctgttggaggatagccacaacggtaaactgtgcaggctgaagggaattgccccccttcaactgggcaagtgcaacattgcaggctggctcctcggtaaccctgagtgcgatcctttactccctgttagaagctggagctacatcgtggagacccccaatagtgagaacggaatctgctaccctggagatttcatcgactatgaagaacttcgggaacagctcagttcagtgtcgagcttcgagagattcgagatctttccaaaggagtccagctggcctaatcacaacacaaatggcgttacagcagcatgctcacacgaaggcaagagcagcttctaccgcaacctgctgtggcttaccgagaaggagggatcctatcccaagctcaagaattcttatgtgaataaaaagggtaaggaagtgctggtcctgtggggtatccatcatccgccaaattctaaggaacagcagaatctgtatcagaatgaaaatgcctacgtgagtgttgtgacttcgaattacaacaggcggtttaccccggagattgctgagcggcccaaagtccgggatcaggctggccgcatgaattattattggactctgctcaagcctggcgacaccatcatttttgaggccaatggcaaccttatcgctcccatgtacgccttcgccctcagtaggggattcgggtctggtatcatcacttcaaacgccagcatgcacgagtgcaataccaagtgccagacaccactcggtgccattaatagctctcttccatatcagaatatacatccagtcacgatcggggaatgccccaaatatgtaagaagtgccaaactgcgcatggtgacaggcctgcggaacaacccaagcatccaaagcagagggctgtttggcgccatcgcgggcttcattgaaggtggttggactggcatgattgatggctggtacggatatcatcatcagaacgagcagggatcagggtacgcggccgatcagaagagtacccagaatgccattaacggcatcacgaataaagtaaatactgtcatcgaaaagatgaacatccaatttactgctgtcgggaaggagttcaacaaactggaaaaaaggatggagaacctgaataagaaagttgacgacggctttttagatatttggacgtataacgcagaactgctcgtgctcctggagaacgagaggaccctggactttcacgactccaatgtgaagaacctttatgagaaagtcaaatctcagctcaaaaacaacgctaaagaaattgggaatggttgttttgagttttatcacaaatgcgacaacgaatgcatggagagcgtcaggaacgggacatacgactatccaaagtactcagaagagtcaaaactcaacagagagaaggttgacggagtcaaacttgagtctatgggcatataccagatcttggcgatctattccacggtggcctcaagccttgttctgttggtctcattgggtgccatcagcttttggatgtgtagtaacggcagtctgcagtgtagaatttgcatc

SEQ ID NO: 435 - DNA, 1695 bp, Influenza A virus
  misc_feature (1)..(1695): Codon Optimized Sequence Encoding H1 Hemagglutinin
atgaaagcaaacctgctcgtgctcctgtgcgctctggcagccgcagatgccgacactatttgcatcggttaccatgccaacaacagcactgatacggtggataccgtactagagaagaatgtcaccgtaacccactcagtgaacctgctcgaagactctcacaacggtaagctgtgtagattaaagggaattgcccccttgcagttaggaaagtgtaacatagcaggttggctccttggcaatcctgagtgtgaccccctactgccagtccgcagctggagctatatcgttgagactcccaactctgaaaatggaatctgttatccaggtgacttcatcgattatgaagaattacgcgagcagttgtccagtgttagctctttcgagagatttgaaatattcccaaaggagtcgtcctggcccaatcacaacaccaatggagtgaccgctgcttgctcccacgaagggaagagctctttctatcggaatctgttgtggctgacagaaaaggagggcagctatcctaaactaaagaacagctacgtgaacaagaagggaaaggaggtgctcgtgctgtggggcattcatcatcctccaaattccaaggagcagcagaacttatatcagaatgagaatgcttatgtctcagtggtgacgtcaaattacaacaggcgcttcacacccgagatcgctgagcggcccaaggtccgcgaccaggctggtagaatgaattactattggaccctcctgaagcccggagatactattatcttcgaagcaaatggaaatttgatcgcacccatgtatgctttcgctctgtccaggggattcggtagtggcattatcaccagcaatgcaagtatgcatgagtgcaacacaaaatgtcagacgccgttaggggctattaacagcagcctcccttatcagaacattcatccggttaccatcggggagtgccctaagtacgtgagaagtgccaaactgaggatggtgacaggcctgcgcaataatcccagtatccagagccgaggtctctttggtgccattgcgggctttattgaagggggctggaccggcatgatcgacggttggtacggataccaccaccagaacgaacagggcagtggctacgccgccgaccagaagagtactcagaacgcaatcaatggaattacgaacaaagttaataccgtaatcgaaaaaatgaatatccagtttaccgccgtaggcaaggagtttaacaagctcgaaaaacgcatggaaaacctgaataagaaagtggatgatggattccttgacatctggacctacaacgcggaacttcttgtcctgctcgaaaatgagagaacgctcgactttcacgacagcaatgtcaagaatctgtacgaaaaggtaaagtcacagctgaagaacaacgctaaggagataggcaacggctgcttcgagttttaccataaatgcgacaatgaatgcatggaatccgtgagaaacggcacttacgattaccccaaatacagcgaagaatcaaagctaaacagggagaaggtggacggggtgaaactagaaagcatgggcatctatcagatcctcgccatttactccacagtcgcatcttctttagtgctccttgtgtcactgggcgctatctcgttttggatgtgctcaaacggatctctgcagtgtcggatctgtatt

SEQ ID NO: 436 - DNA, 1695 bp, Influenza A virus
  misc_feature (1)..(1695): Codon Optimized Sequence Encoding H1 Hemagglutinin
atgaaagcaaatctgctagtgctgctgtgcgccctggccgccgcagatgcagatactatctgcattggttaccatgccaacaactctaccgataccgtggatactgtcctcgagaagaatgtgactgtgactcattccgtgaacttactcgaagacagccacaacggaaagctgtgccgattgaagggcatcgcgccactccagctggggaaatgcaacatcgccggctggcttttgggaaaccccgagtgcgatccgctattgcccgtaagatcatggtcctacatcgtggaaacaccaaattcagaaaatggcatctgctaccccggagattttatcgattacgaggaactgagggagcaactgagcagcgttagttcttttgagcgattcgaaattttcccaaaggagtcctcatggcccaatcacaataccaatggcgttacagccgcttgtagccatgaaggtaagagttcattttatcgaaatcttctctggctgacggagaaggagggtagttaccctaaattgaaaaattcatacgtgaacaagaaaggaaaggaggtgctggtcctctgggggattcaccatccccccaatagcaaagagcaacagaatctgtaccagaacgaaaacgcttatgtctccgtggtcacctcaaattacaatagacggtttaccccggagatagccgagaggcccaaagtccgcgatcaggccggccgcatgaactactactggaccctcctcaagccaggggataccatcatattcgaggcgaatgggaacttgattgccccgatgtacgcatttgctttgtccagaggctttggctccgggatcatcacatctaatgcctccatgcatgaatgcaacacaaaatgccagacacccctgggcgctattaactcctctctaccttaccagaacatccacccggttactattggcgagtgtcctaaatatgtccgcagcgccaaactgaggatggtgacagggctgaggaataaccccagcattcagtccagaggcttgttcggcgctatagcggggttcatagaaggaggctggaccggaatgatcgatggctggtacggctaccaccatcagaacgagcagggctccgggtacgccgctgaccagaagagtacgcagaacgccattaatggaatcaccaacaaggtgaataccgtaatcgagaaaatgaatattcagttcacagctgtggggaaggaattcaataagctggaaaaacgcatggagaacctgaataaaaaagtggatgatggcttcttggatatctggacctataatgcggaactcctggtccttttggaaaatgagcgcacacttgactttcatgactcaaacgttaaaaacctgtacgaaaaagtcaagtcacagctaaagaataatgcaaaggagattggcaacgggtgcttcgaattttatcataaatgcgacaacgaatgcatggaaagcgtaaggaatggtacatacgattatcctaagtacagtgaggagtcaaagttgaatcgcgaaaaagttgacggtgtcaaactggaatccatggggatttatcagattcttgcaatttactcaacggtggctagttctctggtgctgctggtctccctgggcgcaattagtttctggatgtgtagcaacggctctctccagtgccggatctgtatt

SEQ ID NO: 437 - DNA, 1695 bp, Influenza A virus
  misc_feature (1)..(1695): Codon Optimized Sequence Encoding H1 Hemagglutinin
atgaaagcaaatcttctggtcctgctgtgtgcactagccgccgccgacgcagacacaatttgcatcggatatcacgccaacaactctacggatacagtggacacagtgctggagaagaacgtaactgttacacacagcgtgaacctgctagaagattctcacaatggcaaactgtgcagactgaaaggaattgcacccttgcagttgggaaaatgtaatatcgcgggttggctcctcggtaatcccgaatgcgaccccctacttcccgtccgttcttggtcttacatagtggagacacccaactcggagaatgggatttgctatcctggggattttattgactacgaggagctcagggaacagttgagttctgtgtcatcattcgagaggtttgaaatctttcccaaagagtcttcttggcctaatcacaacactaacggtgtgaccgctgcttgttctcacgaaggcaaatcatccttctacagaaatctgctctggctgacggagaaggaaggatcatacccaaagctaaagaattcatatgtgaataaaaaggggaaggaggtcctcgttctgtggggtattcaccatccccctaattctaaagaacagcagaacctttatcagaatgaaaatgcatacgtgtcagtggtgacaagcaactataacaggcgctttaccccggaaatcgccgaacgcccgaaggtgagggaccaggccgggaggatgaactactactggaccttgctgaagccgggcgacacaatcatttttgaagctaacgggaatctaattgctcccatgtacgcctttgctctgtctcgcggctttggcagcgggattatcactagcaacgcgtccatgcacgagtgtaatactaaatgccagacgccactgggcgcaatcaatagcagccttccataccagaacatacatcccgtcaccataggagaatgtccaaagtacgtccggtctgcaaaactaaggatggtgaccgggcttagaaacaacccaagtattcagagccgggggctctttggtgccatcgcaggctttatcgagggagggtggacaggcatgatagacggatggtatggataccatcaccagaatgagcagggcagcggatacgctgccgaccaaaaaagcacccaaaacgctatcaatggcattactaataaggtgaacactgtgattgagaagatgaacattcagttcaccgcagtcgggaaggaatttaacaagctggagaaaaggatggagaacttaaacaagaaggttgatgacgggtttctcgacatatggacgtataacgcggagttgctggtattactggagaatgaacggactcttgacttccacgattcaaatgtgaagaatctctatgaaaaagtcaaatcgcagctcaaaaataatgccaaggagatcggcaacggctgtttcgagttttatcacaaatgcgacaacgaatgtatggaatcagtgcgaaatggcacatatgactatccgaaatactccgaggaaagtaagctgaatagagaaaaggtggacggagtaaagctcgagtccatggggatctaccagattttggctatctattccacagttgcttcatctctggtgctgctggtttccttaggcgccatatcgttctggatgtgctccaacgggtccctgcagtgtcgaatctgcatc

SEQ ID NO: 438 - DNA, 1695 bp, Influenza A virus
  misc_feature (1)..(1695): Codon Optimized Sequence Encoding H1 Hemagglutinin
atgaaggcgaatctacttgtcctgctgtgcgcgcttgcggctgctgacgccgacacgatctgcataggctaccatgcaaataactccactgacaccgtcgacaccgttcttgagaagaatgtgacggttactcactccgtgaacctcttagaggatagtcacaatggcaagttgtgcagattaaaaggcatagctcctcttcagctggggaaatgtaatatcgccgggtggctcctcgggaaccctgaatgcgatcctctgctacctgtgaggagttggagctacatagtcgaaactcctaactcggagaatggaatttgttaccctggagacttcattgattacgaagagctgcgggaacaattgtcctctgtgtcatcatttgagcggtttgagattttccccaaagaaagtagttggccaaatcataacactaacggggtcaccgccgcatgttcccatgaaggaaagagctctttttatcgaaacctcctctggcttactgagaaggaaggatcctatcccaagctcaagaactcctacgtgaataaaaagggcaaagaagttctggtgctgtggggtattcaccatccccccaactcaaaagagcaacagaacctctaccagaatgagaatgcgtacgtgtcagtggttactagcaactacaataggcggtttacaccggagatcgccgagcgtcctaaagtgagagaccaggctggaagaatgaactattattggacgctgctcaaacccggtgacactatcattttcgaggctaatgggaacttgattgcccctatgtatgctttcgccttatcacgcggatttggctccgggatcattacctcaaatgcctcaatgcacgagtgtaacaccaagtgtcagacacccctgggcgcgattaacagcagtctgccgtaccaaaatatccaccccgtgacgattggggagtgccctaagtacgtgcggagtgccaaactgcgtatggtgacagggctgcgcaacaatccttccattcagtcgagaggcctgtttggcgccatcgccgggttcatcgaaggggggtggaccggaatgattgatggatggtatgggtaccatcatcagaatgagcaggggtctggatatgcagcagaccagaaatcgactcaaaatgcaataaatggcataacgaataaagttaatacagtgatagagaagatgaatatccagtttactgccgtgggcaaggagttcaataaactcgagaagcgcatggagaaccttaacaaaaaggtggacgatggattcctggatatctggacttataatgccgagctgctggtacttctcgaaaatgagcgtacactagacttccatgactcaaatgtaaaaaatttatatgagaaggtgaaatcccagctcaagaacaatgcaaaggagatcggcaatgggtgtttcgaattttatcacaagtgtgacaacgagtgcatggaatcagtgagaaacggaacatacgactaccctaaatatagtgaagagtctaagctgaatcgtgagaaagtggacggggtgaaactcgagtctatgggcatttaccagattctggctatttatagtacagtggcttcaagcttagtccttctagtgagcttgggtgccatttcattttggatgtgtagtaatgggtcattgcagtgtaggatttgtatc

SEQ ID NO: 439 - DNA, 1695 bp, Influenza A virus
  misc_feature (1)..(1695): Codon Optimized Sequence Encoding H1 Hemagglutinin
atgaaagcaaacctgctggtcttattgtgcgccttggcagctgccgatgccgacaccatctgcatcgggtaccacgccaataatagtactgacaccgtcgataccgtgctcgaaaagaacgtaactgtgactcacagtgtgaacctgctggaggatagccataacggcaaactctgccgactgaaaggaatcgctcccttgcaactgggcaagtgcaacatagcagggtggttactggggaaccccgagtgcgacccgctgctccctgtaagatcttggagctatatcgtggaaacacctaactcagaaaatgggatatgttacccaggtgactttatcgattacgaagaattgagggaacagctgagcagcgttagtagctttgaacgatttgagatcttcccaaaggagtcctcttggcctaatcacaacacaaatggggtgaccgccgcttgctctcatgagggtaaaagtagcttttaccggaacttactatggctgaccgagaaagaaggaagctaccccaaactgaaaaattcgtacgtgaataaaaaggggaaagaggtgttagtgctctgggggatacatcaccctccaaattccaaggagcagcagaatctgtaccaaaacgagaacgcctacgtttccgtggtgactagcaattataacaggcggtttacacctgaaatcgccgaacggcctaaagttcgagatcaggccgggcggatgaactactattggactttgctcaagcctggcgacacaatcatttttgaagccaacgggaacctgatcgcaccgatgtatgcttttgcactgagtcgggggtttggctctggcattatcacctctaatgcgtccatgcacgaatgtaataccaagtgtcagacacccctgggggctataaactcctccctcccctatcagaacatccaccctgtgaccatcggagaatgtcctaaatatgtccgctccgccaaactgcggatggttactggcctcagaaataatccaagcattcagagtcgaggcctcttcggcgcgatcgccggcttcattgagggtggctggaccggcatgatcgatgggtggtacgggtatcatcatcagaatgaacagggatccggctacgcagcagatcaaaaaagcacacagaacgcgattaatggcattactaacaaggtgaacacggtgatcgagaagatgaatatacaattcactgctgtcgggaaagagttcaataagctcgaaaagaggatggagaatttgaacaagaaagtggatgatggcttcctggacatttggacctacaatgctgaactcctggtccttctggaaaacgaaagaaccctagatttccatgactctaacgtgaagaacctttacgaaaaggtgaagagccagttgaaaaacaacgcaaaggaaattggaaatgggtgcttcgagttttatcataagtgcgacaacgagtgcatggaaagtgtccgtaatggcacttacgattaccccaaatattctgaagaatccaagctgaacagggagaaagtcgatggggttaaattagaatccatgggcatctatcagatactggccatttattccactgtggcgagctccttagtgctcttggtctctttaggtgccatctccttttggatgtgcagtaacgggtccctccaatgcaggatttgtatc

SEQ ID NO: 440 - DNA, 1695 bp, Influenza A virus
  misc_feature (1)..(1695): Codon Optimized Sequence Encoding H1 Hemagglutinin
atgaaggccaacctcctcgttctgctgtgtgcgctggcagcggcagatgccgataccatttgtatcggttaccatgccaacaattccaccgacaccgtcgacactgttcttgaaaagaatgtaactgtcacccattctgtcaacttgcttgaagatagtcacaacggcaaactgtgtcggcttaaaggcatagccccgctgcaactgggcaaatgtaacatcgccggatggctgctgggaaatccagaatgcgaccccctgttgcctgtgcggtcttggagttacatagtagaaacccccaattccgaaaatgggatttgttatcctggcgacttcatcgattatgaggagttgagagagcaattgagtagcgtttcttcatttgagcgcttcgaaatattcccgaaagagagttcatggcctaaccacaacacaaatggagtgacagctgcctgttcccacgaaggaaaaagctccttttaccgtaacctgctatggctgactgaaaaggaggggtcctaccccaaacttaagaactcttatgtcaacaagaaggggaaagaggtactggttctgtggggaattcatcatcccccgaattcaaaagagcagcaaaatctgtaccaaaatgaaaacgcgtacgtctccgttgtgacatctaactacaataggcggttcacgcccgagatcgctgaacggccgaaagtccgggaccaagctggcagaatgaactattactggacactgctcaaacccggcgacaccattattttcgaggcaaatgggaacctgattgcaccaatgtacgccttcgctctgtccaggggctttggtagcggaattatcacctcgaatgcttcaatgcatgagtgcaacaccaagtgccagacacctttgggcgccatcaatagtagccttccttaccagaacattcaccctgtcaccattggtgaatgtcctaagtacgtgcgaagcgccaaactgcggatggttactggcctgcgaaataatccctccatccagtctcgcggtctgttcggagccattgcagggttcatcgagggaggctggaccgggatgattgacggctggtatgggtaccaccatcagaacgagcaaggatccgggtatgccgccgaccagaagagcacccagaacgctatcaatgggattacaaataaagtcaacaccgtcatcgagaagatgaacatccaattcactgcggttggcaaggagttcaacaaactcgagaaaagaatggaaaacttgaataagaaggtagacgacgggtttctggatatctggacttataacgccgaattattggtgctgctggagaatgaacggactttagatttccacgactccaatgtgaagaatctatacgagaaagtgaagtctcagttgaagaacaacgccaaggagataggaaatggctgtttcgagttttatcacaagtgcgataatgagtgcatggaaagcgtgcgcaacgggacatatgattacccgaagtactccgaggaaagcaaactaaatcgcgaaaaggtagatggcgtgaagctggaatcgatgggaatctaccagatcctagctatttactctactgttgccagctctctggtgcttctggtatctctgggggccattagtttctggatgtgcagtaacggctcattacagtgtaggatatgcatt

SEQ ID NO: 441 - DNA, 1695 bp, Influenza A virus
  misc_feature (1)..(1695): Codon Optimized Sequence Encoding H1 Hemagglutinin
atgaaagcaaacttgctggttctgttgtgcgctctcgcggccgctgacgcggacactatctgcatcgggtaccacgcgaataattcgactgacacagttgacactgtgctcgaaaagaatgtgaccgtcacgcactccgtcaatctcctggaggactcacacaatggcaaactttgtcgtttgaagggcatcgcacccctccaactcgggaaatgcaacattgcaggttggcttttaggtaatcctgagtgtgatcccctgctgcctgtgcgcagctggagctatattgtcgagacacccaactccgaaaatggaatctgttacccaggagacttcattgactatgaagaattaagagagcaattaagctccgtgagctcctttgagaggtttgagatcttcccgaaggaaagctcctggcctaaccataacaccaatggagtgactgccgcctgcagccacgaaggaaagtcttccttctatagaaacctactgtggttgacagagaaggaaggctcctatcctaaattgaagaactcatatgtcaacaagaaggggaaagaggtcctcgtgctgtggggaatccatcatcctcctaactctaaggagcaacaaaatttataccagaacgaaaatgcatacgtttctgtggttacatcaaactataataggcgcttcacacctgagattgctgaacgtcccaaagtgagggatcaagcggggcgtatgaactactactggacactgttaaaaccgggggataccatcatctttgaggcgaacggcaatcttattgcacctatgtatgcttttgccctctcgcgcggtttcggcagtggaataataacatcaaatgccagtatgcacgagtgcaatacgaagtgccagactcccttaggcgctataaatagttccttaccttaccagaatattcacccagtgaccatcggcgaatgcccaaagtacgtcaggtctgcgaaactgagaatggtcacagggttgagaaataatccatctatccagtcacgaggcctgtttggcgcgatcgcgggctttattgaaggagggtggacgggtatgattgacggatggtacggttaccatcatcaaaatgaacaaggttcagggtatgccgcggaccagaagagcacccagaatgcaatcaatggcattaccaacaaggtgaacacggtgatcgagaagatgaatattcagtttaccgctgtgggcaaggagtttaataagctcgagaaacgcatggaaaatctgaacaaaaaagtagacgatggattcctcgacatatggacgtacaatgccgagcttctcgtcctcttagagaacgagcggaccctggatttccacgattcaaacgtcaaaaacctgtatgagaaagtcaagagccagcttaagaataacgccaaggaaatcgggaacggctgcttcgagttctatcataaatgcgacaatgagtgtatggaatctgtacgcaatggaacatacgactaccctaagtactccgaagaaagcaaactgaatagggagaaggtagacggagtgaaattggagagcatgggcatataccagatcctggccatttactcaaccgtcgcctcatccttggtgttgctggtgtccttgggtgctatttctttttggatgtgcagcaatggcagtctccagtgcaggatttgtatc

SEQ ID NO: 442 - DNA, 1695 bp, Influenza A virus
  misc_feature (1)..(1695): Codon Optimized Sequence Encoding H1 Hemagglutinin
atgaaggctaacctgctggtgctcctctgcgctctggcagctgcagacgctgataccatttgcattggctaccatgccaataacagcaccgatacagtcgatacagttctggagaagaacgtgacagtgactcacagcgttaatctgttggaggacagccataatgggaagctgtgtcgcctgaagggaattgctccattacagctggggaaatgtaacatcgctggatggctgttgggaaacccagagtgtgatcccctacttcctgtacggagttggagttatatcgtggagacacccaatagtgagaacggtatctgttatcctggagattttatagactatgaagagttaagggagcagctgagctccgtcagttcattcgaacgcttcgaaattttccctaaggagtcttcctggcccaaccacaataccaacggggtcaccgctgcttgtagtcatgaaggaaaatctagcttctaccgaaacctgctctggctaactgagaaagaaggatcatacccgaagctgaagaatagctacgtgaacaagaaggggaaggaagtgctggttctgtggggcattcaccacccccctaacagtaaggaacagcagaacctctatcagaatgagaacgcatacgtgagtgtcgttacaagcaactacaatcgccggtttactccagagatcgcggaaagacccaaagtcagggaccaggctggtaggatgaattactattggacccttctcaaacctggggacactatcatattcgaggccaatggcaacctgattgcccctatgtacgcctttgctctgagccgcggattcggctccggcataatcacgtctaatgcttccatgcacgagtgtaacacaaaatgtcagacgcccttgggcgctatcaattctagtctgccttatcagaacatacatccagtcactatcggagagtgcccaaagtacgttcgctctgcaaagctccggatggttacaggtctaagaaataatcctagtattcagagcaggggcctgtttggagccatagctggatttatagagggcggatggactgggatgatagatgggtggtatggctaccatcaccagaatgaacaggggagcggatacgctgccgaccaaaaatctactcagaacgcaattaatggtatcacaaacaaagtgaacacagtgatcgaaaagatgaacattcagttcactgctgtggggaaagagttcaacaagctggagaaacgaatggaaaatctgaataaaaaggtggacgacggattccttgacatttggacttacaacgccgaattacttgtcctcttggaaaacgaacggaccctggattttcatgactccaatgttaagaacctgtatgagaaggtgaagagccagctgaaaaataacgcaaaggaaatcgggaacggatgttttgagttttaccacaagtgcgataatgaatgtatggagagtgttcggaatgggacatacgactaccctaagtattctgaggagtctaagctcaaccgggagaaggtggatggtgttaagttagagagtatgggaatttaccagattctggccatatactctacagtagcatcttctctggtgttattggtcagtctcggtgctatttctttttggatgtgctcaaacggctcactgcagtgccgcatctgtatc

SEQ ID NO: 443 - DNA, 1695 bp, Influenza A virus
  misc_feature (1)..(1695): Codon Optimized Sequence Encoding H1 Hemagglutinin
atgaaagcaaacctgctggtcctcttgtgcgcgctggcagccgccgatgctgacaccatatgtattggctatcacgctaacaattctacggacactgtggatacggtgctggagaaaaacgtaaccgtcacacacagcgtgaatctgctggaggattcgcataatggtaaactttgcagactgaaggggatagccccgctccagttgggtaagtgtaatatcgccggatggttgcttgggaaccccgagtgtgatcctctgttgccggtgcgcagttggtcgtacatcgtggaaaccccgaatagtgagaatggcatttgttatccaggggacttcatcgattacgaagagctcagggagcagctcagctctgtaagtagcttcgaacggttcgagatcttccccaaagaaagctcctggcccaatcacaacactaacggggtgacagcggcctgcagccacgagggcaaaagttctttctatcgcaacctactgtggctcaccgagaaggagggaagttaccctaagctgaagaacagctatgtcaacaagaaaggcaaggaggtccttgtgttatggggcattcaccaccctcccaatagcaaagagcagcaaaacctttatcaaaatgagaacgcctacgtgagcgtggtgacctctaactacaacagaaggtttacaccagagatcgccgaaaggcctaaagttagggaccaggccggacggatgaattactattggacgttattaaagcctggggataccattatctttgaggccaatggcaacttgatcgcccctatgtacgcctttgctctctcgcgcggatttggttccggaatcattaccagcaatgcttcaatgcatgagtgcaatacaaagtgtcagaccccactgggcgctattaactcgtctttaccgtatcaaaatatacatcccgtgactattggtgagtgccctaaatatgttcgctctgctaagctcaggatggttactggactgcggaacaatccgtcgattcagtccaggggactcttcggcgcaattgcgggtttcatcgagggtggctggacgggcatgatcgacggctggtacggttaccaccatcagaacgaacagggatccggctacgcagccgatcaaaagtctacgcagaacgctattaatggaatcaccaacaaggtgaatacagttatcgaaaagatgaatatacagtttactgccgtggggaaagaattcaacaaactggagaagagaatggagaatcttaacaagaaggtcgacgatggcttccttgatatctggacgtacaatgccgagctgctggtcctcctcgagaatgaacgaactctggacttccacgactccaatgtaaagaatctctatgaaaaggtgaaatcccagctgaaaaataacgccaaggagataggaaatggctgcttcgaattttaccacaaatgtgacaatgaatgcatggagtccgtgagaaatggaacctacgactatcccaaatattcagaagagtcaaagctaaatcgcgaaaaagttgacggagtcaagctcgagtctatgggcatatatcagattctggccatctactccaccgtggcctcttcccttgtccttctagtgtccttgggtgcaatttctttttggatgtgcagcaacgggtccctgcaatgcaggatttgtata

SEQ ID NO: 444 - DNA, 1695 bp, Influenza A virus
  misc_feature (1)..(1695): Codon Optimized Sequence Encoding H1 Hemagglutinin
atgaaggccaaccttctcgtcttactatgtgcacttgccgcagcagatgccgatactatctgcatcggctatcatgccaataacagcacagacaccgtggatacggtgctggagaagaacgttacagtgacccactccgttaatctgcttgaagatagtcataacggcaagctgtgtcgcttgaaagggatcgcccctctccagctgggtaagtgcaacattgctgggtggctccttggcaaccctgagtgtgacccactacttcctgtgagaagttggagctatatcgtagagacaccaaattctgaaaacggaatctgttatcccggagacttcatcgactacgaggaactgcgcgaacaactgtcttccgtctcttcctttgagagatttgagatctttcccaaagaaagtagttggccaaaccataatactaacggcgtgacagcagcctgtagtcacgaaggcaagtccagtttttaccgcaacctgctctggctgacagaaaaggaggggagttatccaaagctgaaaaactcttacgtcaacaagaaagggaaagaggtcctggttctttggggcattcatcatcccccaaattcaaaggaacagcagaatctttaccagaacgaaaatgcttacgtgagtgtggtcaccagtaactacaacaggaggttcacaccagagatagcagaacggccaaaagtaagagatcaggctggtaggatgaactattactggacactgctcaagccgggtgacaccataatctttgaggctaatggcaaccttattgctcccatgtacgctttcgctcttagcagagggtttggcagcggcattatcacatcaaatgcaagcatgcacgagtgcaacaccaagtgtcaaacacccctcggcgcaataaatagcagcttgccatatcagaatatacaccccgtgacaatcggcgagtgtcctaaatacgtacgctctgcaaaactccgcatggtgaccggcctccgtaacaaccccagcatccagagtcgggggctctttggcgccatcgccgggtttattgaaggggggtggacagggatgattgatggttggtatggatatcaccaccagaacgaacaaggatcaggttacgcggcggaccagaagagcacccaaaacgctataaacggcataaccaacaaggtaaacaccgttattgaaaagatgaatattcagtttaccgcagtcggtaaagagtttaataagctcgagaagaggatggaaaatctgaacaagaaggttgatgatgggtttttagatatttggacctacaatgcggagctgctcgtcctgttagaaaatgagaggacactggacttccacgatagtaatgtgaagaacctctatgagaaggtgaaaagtcagctcaagaataacgctaaagagattgggaatggttgttttgaattttatcacaaatgcgacaatgaatgtatggagagtgtaaggaacggtacgtacgactacccaaaatattcagaagagtctaaactcaatagagagaaggttgacggagtgaaactggagtccatgggcatttaccagatcctggcaatctactctactgttgctagctcgttggtgttgctcgtcagtctgggagctatctccttctggatgtgtagtaatgggagcctgcagtgccggatctgtatt

SEQ ID NO: 445 - DNA, 1695 bp, Influenza A virus
  misc_feature (1)..(1695): Codon Optimized Sequence Encoding H1 Hemagglutinin
atgaaggctaatctactggttcttctgtgcgcgctcgccgcagcagatgctgatactatctgcatcgggtatcatgctaataacagcaccgacaccgtcgatacggtactagagaaaaacgttactgtgactcactccgtgaacctgctggaagactcacataacggcaaactgtgtcgcctgaaggggattgcccccctgcagctggggaagtgtaatatagcgggatggctgttggggaatcctgagtgtgatccacttctccccgtgagatcctggagttacattgtggagactccaaattcggagaacgggatctgctatccaggagacttcatcgactacgaagaattgcgagagcaactgtctagcgtgtcctcctttgaaagattcgagatttttccaaaggagtccagttggcctaaccataacactaacggcgtgactgccgcttgttctcacgagggcaagtcttctttttatagaaaccttctctggctcaccgaaaaagaaggttcctatcccaaactcaaaaactcctacgtgaataagaaaggcaaagaagtcctggtgttgtggggtatacaccatccgcctaactccaaggaacagcagaatctctaccagaacgagaatgcatacgtgtcagttgtcacctccaactacaaccggcggttcacccctgagatcgccgaaaggccaaaagtgcgtgaccaggccggacgcatgaactactactggactctcttgaagccaggagacaccattatcttcgaagccaatggcaacctgattgcccccatgtacgctttcgcactcagcagaggtttcgggtccggcataattactagcaacgccagcatgcacgaatgcaacactaaatgtcagaccccactcggagccatcaactccagtctgccctaccagaatattcaccctgtcaccatcggcgaatgccccaagtacgtgaggagtgctaaacttcgaatggtgaccggcctgcggaacaatccgagcattcagtcccggggattgtttggagccatcgctggatttatagaggggggctggaccggcatgatcgacggctggtatggctatcatcatcaaaatgaacagggcagcggctatgcagctgaccaaaagtcaacccagaacgctattaacggaatcacaaacaaggtgaataccgtgatagaaaagatgaatattcagttcacggctgtgggaaaggaattcaacaagttagagaagaggatggaaaatctgaataagaaggtggacgacgggttcttggatatctggacatacaacgctgagctcttggtgctgctcgaaaatgaacggactcttgactttcacgactcaaacgtaaaaaatctctatgaaaaggtgaaatctcagttgaagaataacgcaaaggagattggcaatgggtgcttcgaattctatcacaagtgtgataacgagtgtatggagtcagtccggaatgggacttacgactatcccaagtatagtgaagaatctaagctcaatcgcgaaaaggtggacggggtgaagttggaatcaatgggtatttatcagatcctcgcaatttactctaccgtggcctcctcattggttttgctggtgtcccttggagctataagcttctggatgtgcagtaatgggtcactacagtgccgtatttgcatt

SEQ ID NO: 446 - DNA, 1695 bp, Influenza A virus
  misc_feature (1)..(1695): Codon Optimized Sequence Encoding H1 Hemagglutinin
atgaaggccaacttgctggtgcttctttgcgccctcgcagcagctgacgccgataccatctgtataggctatcacgcaaacaatagcaccgatactgtggataccgtgcttgagaagaacgttacagtgacacattcagtgaacctactcgaggactcccacaatggaaagctgtgtaggctgaaaggcattgcaccactgcagctcgggaaatgtaatatagcagggtggctcctcggcaatcccgagtgcgatcccctgctgcccgtcaggtcatggagctacattgtagaaaccccgaactctgagaatggcatttgttatcccggagatttcatcgactacgaagaactgcgagagcaactctcatccgtgtcttcatttgaaaggttcgagatcttccccaaggagtctagctggcctaatcacaacacaaacggcgtgactgccgcctgttcacacgagggtaagagttcattttacaggaacctcctgtggctgactgagaaggaaggcagctatccaaagttgaagaattcgtacgtgaacaagaaggggaaagaagttctggtactctgggggatccaccacccgcctaattccaaagaacagcagaatctataccagaacgaaaatgcttacgtcagcgttgtgacatccaattacaacagaagatttaccccagagatagccgagcgacccaaggtgagggaccaggcgggacgaatgaattattactggaccctgttgaagccaggagacaccatcatttttgaagccaacggaaatcttatcgcgccgatgtacgcgttcgcactgtcacgaggatttggctcggggattattacctcaaatgctagcatgcacgaatgcaacactaagtgtcagactccgctgggagctatcaattcatctctcccatatcagaatattcatcccgtgaccataggcgagtgccccaaatacgtccggtcggcaaaattgcggatggttactggtctgagaaataatccatccatacagtctcgcggtttatttggggcgattgcaggctttattgaggggggatggacgggcatgatcgatggttggtacggatatcaccaccaaaacgagcaagggagtggttatgccgccgatcagaagtcgacacaaaacgcaataaatggtataacaaataaagttaacaccgtaatcgagaagatgaacatccagtttacagccgtggggaaggaattcaacaagctggaaaagcgcatggagaacctgaacaaaaaggtggatgacggcttcctggacatttggacctacaacgcagagttgttagtgctgctggagaatgagcgaacactggattttcatgactccaatgtgaagaatctctacgagaaggtgaagtcacagctcaagaacaatgctaaagagattgggaacgggtgcttcgaattttaccataaatgcgacaacgagtgtatggagtccgtccgtaatggcacttatgactaccctaaatactctgaagagtccaaactcaatcgggagaaagtggacggtgtgaagctggagtcaatggggatataccagatcttagcaatttacagcaccgtcgcctcctcattggtgcttctggtctctctcggagcaattagtttttggatgtgttccaatgggtctctccagtgccggatatgcatt

SEQ ID NO: 447 - DNA, 1695 bp, Influenza A virus
  misc_feature (1)..(1695): Codon Optimized Sequence Encoding H1 Hemagglutinin
atgaaagccaaccttctagtgttactttgcgctctcgccgctgccgatgccgatacaatctgtatcggttatcacgcgaataattccaccgacactgtcgatacagtgttggaaaagaatgtcacagtcacacattccgtcaatttgttggaggacagccataacggaaagttgtgtagattgaaagggattgccccactgcagctgggtaagtgtaatattgctggttggctactgggcaacccagaatgtgacccccttctacccgtcaggagttggagctacattgtggagacccctaacagcgagaatggcatttgctacccaggcgactttatcgattacgaagaactgcgggaacagttgagctctgttagtagcttcgagagattcgagatattcccaaaggagtcaagctggcccaatcacaacaccaatggggttacagcagcttgtagccatgaaggcaaaagcagcttctatcgaaatctactctggctcaccgaaaaggaaggatcctacccgaaactcaaaaacagctacgtcaacaagaagggaaaagaggtgctggtgctgtggggaatccatcatcctcccaacagcaaagagcaacagaatttgtatcaaaacgaaaacgcttacgtgagcgtggtaacctcaaactataacagacggtttacaccagaaatcgcagagaggccaaaagtgcgggaccaagccggtagaatgaactattactggaccctcttgaaacctggagacaccataatattcgaggccaacggaaatctgatcgccccaatgtatgccttcgctctctctaggggcttcggcagcgggataattacctccaacgccagcatgcatgagtgcaataccaagtgtcaaactcccctgggcgcaattaacagctccctgccttaccaaaacattcacccagtcaccatcggagagtgccccaaatacgttagatctgcaaagctgcggatggtgacaggtctacgcaacaacccctcaatccagtcacgggggcttttcggtgccattgccgggtttattgaaggtggctggaccggcatgatagatgggtggtatggctaccaccatcagaatgaacagggaagtgggtatgcagcggaccagaaaagcacgcagaacgcaataaacgggatcacgaataaagtgaacaccgtcattgaaaagatgaacatccagtttaccgcggttggaaaagaatttaacaagctcgaaaaaagaatggaaaatctgaacaagaaggtcgacgacggattccttgatatttggacttacaatgctgagcttcttgtactgttagaaaacgagcgaaccttggatttccacgattcaaacgtcaaaaacttgtacgagaaagtgaagagccaactcaagaacaacgccaaggaaattgggaatggttgctttgaattttaccataagtgcgacaatgaatgcatggagtcggtacgaaacgggacttatgattatccaaagtatagcgaagagagtaaactcaaccgggagaaagtcgatggggtgaaactggagtcaatgggaatttatcaaattctggctatctattctacagtggcctcttctctcgtcttgctagtgagcctcggagcaatctctttttggatgtgcagcaatggctccctgcaatgccgcatctgcata

SEQ ID NO: 448 - DNA, 1695 bp, Influenza A virus
  misc_feature (1)..(1695): Codon Optimized Sequence Encoding H1 Hemagglutinin
atgaaggctaacctcctggtgttgttgtgtgccctggctgcagctgacgccgatactatttgcataggctatcatgctaataatagtacagatacggttgacaccgttctcgaaaagaacgtgacggtgacacatagcgttaatctgctagaagactcccacaatgggaagctgtgccggctgaaggggatcgcaccactccagctaggtaagtgcaatatcgccgggtggctgttaggaaatccggagtgcgaccctcttctccccgtgaggtcttggtcctacatcgtggaaactccaaacagtgaaaacggaatctgctatcctggcgattttatagactatgaagagctgcgtgagcaactgagcagcgtatccagcttcgaaagattcgagattttccctaaggaatcgtcatggccgaatcacaacactaatggcgtcactgctgcatgcagccatgagggcaaaagcagcttctatagaaatctcctgtggcttaccgagaaagagggtagctatcctaagctcaagaatagctatgtcaataagaaaggcaaggaggtgctggtgttgtggggaatccatcacccacctaactccaaagagcagcagaacctgtatcaaaacgagaacgcctacgtgtctgtagtgacgagcaactacaacaggcgtttcacacctgagatcgcggagcgccccaaggttcgcgaccaagcggggcgcatgaattactattggactcttttaaagccgggagatacgatcatctttgaggctaacggcaacttaatcgcccctatgtacgcctttgcgttgtcgcggggattcggatccggtataataacaagcaacgcaagtatgcacgaatgtaatactaaatgtcaaacccctttaggggccattaacagcagccttccgtaccagaacattcatcccgtcaccatcggcgaatgcccaaaatatgtgcggtccgcgaaactcagaatggtaacaggcctgcggaataatcctagtatacagtccagaggactttttggggcgatagctggattcattgaaggcggatggactgggatgattgacggatggtacggctaccaccatcagaacgaacagggcagtgggtacgctgctgatcaaaaatccacacaaaatgccattaatggaattacaaacaaagttaatacagtcatcgagaaaatgaatattcagttcacagctgtgggcaaagagtttaacaaactggagaaacgaatggagaacctgaacaaaaaggttgatgatggctttctggacatctggacatataatgctgagctgttggtcctactggagaatgagaggaccttggacttccacgactccaatgttaagaacctatatgagaaggttaagtcgcaattgaaaaacaatgcaaaggaaatcgggaacgggtgctttgaattctatcataaatgtgataatgagtgcatggaaagcgtgcgtaatgggacttacgattatcctaagtatagtgaggaatctaagttgaacagagagaaagtggatggagtcaagttagaaagtatgggtatctaccaaattcttgctatatatagcacagtggcttccagcctcgtcttgcttgtctctctcggggctatcagcttttggatgtgctcaaacggcagcctccagtgtcggatatgtatc

SEQ ID NO: 449 - DNA, 1695 bp, Influenza A virus
  misc_feature (1)..(1695): Codon Optimized Sequence Encoding H1 Hemagglutinin
atgaaggctaacctgctggtgctgttgtgtgcactcgcagccgcggacgccgacactatctgcataggctatcacgctaataactcaacggatacggtggataccgttctggagaagaatgtaaccgtcacacacagcgtcaatctgctcgaggatagccacaacggcaaactatgccgcctgaaggggatagctcccctccagctgggaaagtgtaacattgccggatggctcctgggaaatccagagtgcgatcccctgttacctgtcagatcatggtcttacatcgtggagacccctaactccgagaatgggatctgctaccccggagactttattgactacgaggagctgagagagcaattgtcttcagtgagttcttttgagaggtttgaaatcttcccgaaggagagttcatggccaaatcacaatacgaatggagttaccgcagcttgctctcatgagggcaagagcagtttctacaggaacctactgtggctgaccgagaaggaaggtagctacccgaagctgaagaattcatacgtcaataaaaagggcaaggaagtgttagtgctctggggcatccatcacccccccaactccaaagagcagcagaacctttatcagaatgaaaacgcttatgtttcagtggtgacctctaattataaccgacgttttactccagagatcgctgaaagacccaaggtccgtgaccaagcagggcggatgaactattactggaccctgctaaagcctggcgatactataattttcgaagctaacggcaaccttattgctcccatgtatgcattcgccctgagtcgtggatttggcagcggtattatcacctctaatgcatcgatgcatgaatgtaatacaaaatgccagactccattgggcgctattaactcaagccttccttatcaaaatatccaccctgtaactatcggggagtgtcccaaatatgtgcgctcagccaagctccgcatggtaactggactccgcaacaatccatcaatacagagcagaggactgttcggggcgatagccgggttcatcgaaggaggctggaccggcatgatcgacgggtggtacggttaccatcaccaaaacgagcagggcagcggctacgctgccgatcaaaagtccacacaaaatgccataaacggaataaccaataaggtcaacactgtgatcgaaaagatgaatattcagttcactgctgtcggtaaagaattcaataagctggaaaagcgcatggagaaccttaacaaaaaggtggacgacggctttttagacatctggacctacaatgccgaactgctagtgctacttgaaaacgaaaggaccttggattttcacgacagtaatgttaaaaatctctacgagaaagtaaagtctcagttgaagaacaatgctaaggagatcggcaatggatgctttgagttctatcacaagtgcgataacgaatgcatggaaagtgtgcgcaacggaacctatgactaccccaagtattccgaagagagcaagcttaacagagagaaggtcgacggagtgaagctggaaagtatggggatctaccaaatactggcaatatacagcacagttgcaagcagtctcgtgttactcgtctcccttggagcaatctctttctggatgtgttctaacggcagcctgcagtgcagaatttgtatc

SEQ ID NO: 450 - DNA, 1695 bp, Influenza A virus
  misc_feature (1)..(1695): Codon Optimized Sequence Encoding H1 Hemagglutinin
atgaaggcaaacttgctcgtgctgttgtgcgcattagccgccgccgatgccgacacaatctgcatcggctatcacgctaacaactccactgacactgtggataccgtacttgaaaaaaatgtgaccgtcacacactcggttaatctcttagaggactcgcacaatggcaaactgtgtcgtctgaaagggatcgctccacttcaactcgggaagtgtaatattgccgggtggctgctgggcaaccccgagtgcgaccctcttctgcctgtacggtcgtggtcttatatagtggaaacacccaatagtgagaacggcatatgctatcccggagacttcattgattatgaagaacttagggaacagctaagctccgtgtcaagctttgaaaggtttgaaatattccccaaggagagctcctggcctaatcacaataccaacggtgtgaccgccgcctgttcgcacgagggcaagagctcattttacaggaatctactgtggctcaccgagaaggaaggttcgtaccctaagctcaagaatagctacgtgaataaaaagggcaaagaggtactggtgctgtgggggattcaccacccccctaattcgaaggagcagcaaaacttgtaccagaatgagaatgcctacgtctctgttgtcactagtaattacaaccgtagattcacgcctgaaattgctgagcgaccaaaagttcgagatcaggctggcaggatgaattattattggaccctcctgaagcccggagataccattatcttcgaggctaatggtaacctgatcgctcctatgtacgccttcgctttgagtcgaggcttcggcagcgggataattacgtctaacgcttctatgcacgagtgcaatacaaagtgtcagactccccttggggcaatcaattcaagccttccctatcagaatatccaccctgttactataggggagtgtccgaaatacgttaggtcggcaaagctgaggatggtcactggcctgcgaaataacccgtccattcagtccagggggcttttcggtgctatcgctggatttattgaaggtggttggactggcatgatcgacggatggtacgggtatcaccaccagaacgaacagggatctgggtacgctgccgatcaaaaatcgacccagaacgccataaacggcattacaaataaggtgaataccgtcatcgaaaaaatgaatattcaattcaccgccgtaggcaaagagtttaataaacttgagaaaaggatggagaacctcaataaaaaagtcgacgatgggtttctggatatctggacctataacgctgagcttcttgtgctgctcgaaaatgaacgcacactggatttccacgattccaacgtgaaaaatttgtacgaaaaggtgaagtcacaactgaagaataacgcaaaggaaatcgggaatggctgttttgaattctatcacaagtgtgacaacgaatgcatggagagtgtccgaaacggaacctacgattatccaaagtactcggaagaatctaagctgaatcgggagaaggtggacggggtcaagctggagtcaatgggtatttatcagatcctagcgatttactcaaccgtggcatcgagcctggtcctacttgttagtcttggggcaataagcttctggatgtgcagcaacggcagcttgcagtgcagaatatgtata

SEQ ID NO: 451 - DNA, 1695 bp, Influenza A virus
  misc_feature (1)..(1695): Codon Optimized Sequence Encoding H1 Hemagglutinin
atgaaggctaacctgctcgttctcttatgtgcactggccgccgcagacgcggatactatttgtataggctaccacgcgaataactctactgatacggtggacacagttctcgagaaaaacgtgacagtgactcactccgtgaatctgctggaggattcacacaacggcaaactgtgtcgactgaaaggaatcgcaccgttgcaacttggtaagtgcaatattgccggatggctcctgggaaaccccgaatgcgatcctttgcttcccgtgcggagttggtcctacatcgtggagacccctaactctgagaacggaatctgttatcccggggatttcattgattatgaagagctcagagaacaattgagttctgtttctagctttgagagattcgagattttccctaaggagtcgtcctggccaaatcacaacactaacggagtaaccgccgcctgttctcacgagggcaagtcaagcttttacaggaatctcctgtggttaacagaaaaggaagggagttacccaaaactaaaaaactcgtacgtgaacaagaaaggcaaggaggtcctggtgctgtggggaattcatcaccccccgaattccaaggaacaacagaatctgtatcaaaacgaaaacgcttatgtgtccgtcgtgacatcgaactacaatagaagatttacccccgagattgcagagcgccctaaagtcagggatcaggctgggagaatgaactattattggacactgctaaagcccggcgatacaattatctttgaggccaatggcaatctgattgctcccatgtatgcatttgccctgagcagagggtttggcagtggaatcattaccagcaatgctagcatgcatgaatgtaatacaaagtgtcagacaccattaggagccataaacagttcactcccttatcagaacatccatcccgtgacaatcggagagtgtcctaaatacgtcagaagtgcaaaattgagaatggttaccggcttgaggaataatccatctattcaatcccgcgggctctttggagccatcgctggctttattgaaggaggatggaccggaatgattgatggatggtatggttaccaccatcagaatgagcagggctccggctacgccgccgaccagaagtctacccaaaacgccataaacggaatcaccaataaggtgaacactgtcattgaaaagatgaatatacaattcactgccgtcgggaaggagtttaacaaactcgaaaagcggatggagaatttgaataaaaaggtcgacgacggcttcctggatatctggacatacaatgccgagctcctggtcctgttggagaatgaacgcacactcgattttcacgacagcaatgtgaagaatctttacgaaaaggttaaaagtcagttgaaaaacaacgctaaagaaataggtaatgggtgtttcgagttttaccacaagtgcgacaatgagtgcatggaatctgtcagaaatgggacctacgactaccctaagtactccgaagagtctaagctgaatagggagaaggtggatggggtgaagctggaatccatgggcatctaccagatcctcgctatctacagcacagtggcctctagcttggtgcttttggtgtcacttggggcgatttcgttctggatgtgctccaacggaagcctgcaatgccgaatctgtatc

SEQ ID NO: 452 - DNA, 1695 bp, Influenza A virus
  misc_feature (1)..(1695): Codon Optimized Sequence Encoding H1 Hemagglutinin
atgaaggctaaccttcttgtgcttctctgtgcacttgctgccgcagatgctgatacaatatgcatcggttaccacgctaataattctaccgatacggttgacacggttcttgaaaagaacgtcacagtgactcacagcgtcaacctcctggaggactctcataacggaaaattgtgccgcctcaaaggcattgccccattgcaattaggcaagtgtaatattgcaggttggctcctgggtaacccggaatgcgaccctctgttgcctgtcaggtcttggagttatatagtcgaaaccccaaattccgaaaatggaatatgttaccctggcgactttatcgactacgaagaactgagggagcagcttagttccgtcagttctttcgaacgtttcgaaatcttccccaaggaatctagttggcccaaccataacaccaacggtgtgacggcggcatgcagtcacgagggcaagtccagcttctatagaaacttgctgtggttaaccgagaaagagggaagttaccctaagctgaagaacagctacgtaaacaaaaaaggcaaagaagtcctggttctctggggcattcaccacccacccaattccaaggaacagcaaaatctctatcaaaatgaaaatgcttatgtctctgttgtgacctcgaactataatcggcgttttacccctgagatcgccgagaggcctaaggtcagggaccaagctggccgaatgaattattactggaccctactgaagcctggcgataccataatcttcgaggctaatggaaatctgattgcgccaatgtatgcttttgcactgagccgcgggtttgggagcggaattatcacctctaacgcatctatgcacgagtgtaacacaaagtgtcagaccccgctgggggctattaactccagtttgccataccaaaatattcatccggtcacaatcggtgaatgccccaagtatgttagaagcgctaagttaagaatggtgaccgggctgcgtaacaaccctagtatccagtcacgcggcctctttggggctattgccgggttcatcgagggaggttggactgggatgatcgacggatggtatgggtaccaccatcaaaacgagcagggatcaggctacgccgcagaccagaagagcactcagaacgccatcaacgggatcactaataaagttaataccgtgattgaaaaaatgaacatacaatttactgcagtgggcaaggagttcaacaaactagagaaacgcatggagaacttgaacaaaaaagttgacgacggatttctggacatctggacatataatgcagagctgctggtcctgctagagaacgaacggaccctagacttccatgactcaaacgtcaagaatctgtacgagaaggtgaaatctcagctcaaaaataatgccaaagagatcggcaatggatgctttgaattctatcacaagtgtgacaatgagtgcatggagagcgtgcgaaatggaacttacgactacccaaagtacagcgaggagagtaagcttaacagggagaaggtggacggcgtgaagctcgaaagcatggggatataccagatcctcgccatatactctactgtggcgtcgtctctcgtgcttttggtatcactcggcgctatcagcttctggatgtgttccaatggcagcttgcagtgccggatatgcatt

SEQ ID NO: 453 - DNA, 1695 bp, Influenza A virus
  misc_feature (1)..(1695): Codon Optimized Sequence Encoding H1 Hemagglutinin
atgaaagccaatctcttagtgctactgtgcgcccttgccgccgcagacgcagatacgatttgcattgggtatcacgcaaacaattccaccgacacagtggataccgtgctcgaaaagaacgtaactgtgactcactctgtgaatttactcgaggacagtcacaacgggaagctctgcagacttaaggggatcgcacccttgcaactcggaaagtgtaacattgccgggtggcttctcggcaaccccgagtgtgaccctcttcttccagttcggagctggagttatatagtggaaacgccaaattccgagaacggcatatgttacccaggagactttatcgattatgaagaactccgcgaacagctcagcagcgtgagttctttcgaacgtttcgagatcttcccaaaagagtccagttggccaaatcataacaccaatggcgtaacagcagcgtgcagccacgagggaaaatctagcttttacaggaacctactttggctcacagaaaaggagggatcctatcctaaactgaagaattcatacgtcaataaaaaaggtaaagaggtgttggtgctgtgggggattcatcacccaccaaactccaaagaacagcagaacctgtaccaaaacgagaacgcctacgtctccgtggtgacgagcaactataaccgacgctttacccccgaaatcgcggagcgtccaaaggtgcgggaccaggcagggcgtatgaactattattggacacttctaaaacccggtgacaccattatctttgaagcgaacggcaacttgattgcgccaatgtatgctttcgctctgagtcggggatttggatcggggattattacctccaacgcgtctatgcatgaatgtaacaccaaatgtcaaacccctcttggggccatcaacagctccctgccatatcagaacattcacccagtcaccatcggagaatgccccaagtatgtccgcagtgctaagctccgcatggtaaccggcctgagaaacaatcccagtattcagtctaggggcctcttcggcgctattgcaggattcattgagggcggatggacaggcatgatcgatggctggtacggttatcatcaccagaacgagcaaggatccggctacgctgcggaccagaagagcacccagaacgctattaacggcattacgaataaggtgaacactgtcatcgagaagatgaacattcagtttaccgcggttgggaaggagttcaacaaacttgaaaaacgaatggagaatctaaacaaaaaagtcgacgatggattcctggatatctggacctacaacgctgagctgctggtgctgctggaaaatgagcggacattggacttccacgattccaacgtgaagaatctttacgagaaagttaaatcacagttgaagaataatgccaaagagattgggaacggctgttttgaattctaccacaaatgcgataacgaatgtatggaatctgtacggaatggtacgtatgactatccaaaatactccgaagagtccaagctgaaccgagaaaaagtggacggggtcaaactggaaagcatggggatataccagatcctggccatatatagcactgtggcttcttctttggttctccttgtgtcactcggggccataagcttctggatgtgttcaaacggaagcttgcagtgcagaatttgcatc

SEQ ID NO: 454 - DNA, 1695 bp, Influenza A virus
  misc_feature (1)..(1695): Codon Optimized Sequence Encoding H1 Hemagglutinin
atgaaggccaacttactggtgttgctatgcgctctggccgccgctgacgccgataccatctgtattggataccacgccaacaacagcaccgacactgtggacacagtgcttgagaagaatgtcaccgtcacacatagtgtaaacttgctcgaagatagtcacaacgggaagctgtgccgccttaaaggtattgcaccactgcagttaggcaagtgcaatattgccgggtggctgcttgggaaccccgagtgtgatcctctattgccagttcggtcgtggagctatatcgtggagacaccgaacagcgaaaacggcatctgttatcctggagattttatcgactatgaggaactcagggaacagctctcgtctgtgtctagcttcgaacgctttgaaattttcccaaaagagagttcctggccaaatcataacactaacggtgtgactgccgcttgctcccatgaaggcaaatcaagcttttataggaatctgttgtggttgactgaaaaagaaggctcctacccgaaactcaagaacagctatgtgaacaagaaaggtaaggaagtgctggtgctgtggggcatccatcatcctcctaactcaaaggagcagcaaaatctttaccagaatgaaaacgcatacgtgtccgttgtaacctctaattataaccgccggttcaccccagaaatcgccgagcgtccaaaggttagagatcaagcagggcgcatgaattattactggacactgctcaagcccggcgataccatcatctttgaggctaacggcaacctcattgctccgatgtatgcgttcgctctgagtcgcggctttggctcaggcattattacttccaatgcctctatgcacgagtgcaacactaaatgccagacgcccctgggtgcaatcaactctagcctcccatatcagaacatacatcccgtgaccatcggcgaatgccctaaatacgtccggtccgcaaagctgcgaatggtgacgggcctgagaaataacccctcaatacagtcgcgagggctgttcggcgccattgccgggtttattgaggggggatggactgggatgatagatggttggtatgggtatcatcatcagaacgagcaagggtctgggtatgccgctgaccaaaaaagcacccagaacgccataaacgggattaccaataaggttaacacagttattgagaagatgaatattcagtttaccgctgtcgggaaagaattcaataaattggaaaaaaggatggagaacctgaacaaaaaggtggacgatgggtttctcgatatctggacatataacgctgagcttctcgtactgctggaaaatgaaaggacgctcgatttccatgattccaatgtcaagaatctctacgagaaggtcaagtctcagctgaagaacaatgccaaagagatcgggaatggatgttttgagttctatcacaagtgcgataacgaatgcatggagtccgtcaggaacggcacctatgattaccctaagtacagtgaagaaagcaaacttaatagggaaaaggtggatggtgtgaagctggagtcaatgggcatttaccagattctggccatttacagtacagtagcctctagtctggtgctgcttgtcagccttggcgccatctccttttggatgtgtagcaacggatcactgcagtgcaggatctgcatt

SEQ ID NO: 455 - DNA, 1695 bp, Influenza A virus
  misc_feature (1)..(1695): Codon Optimized Sequence Encoding H1 Hemagglutinin
atgaaagcaaacttgcttgtgctgttatgcgctctggcagctgcggacgccgatactatctgcatcggttaccacgctaacaattcaacagataccgttgatactgtgctggagaagaacgtgaccgtcacccacagtgtgaacctcttggaagacagccacaacggaaaactgtgccgcctgaagggcatcgcgccgttacagctgggaaagtgcaatatcgccggatggcttttgggtaatccagaatgtgatccattgctccccgtgagaagctggagctatattgttgaaacccctaactcagagaatgggatctgctaccccggggacttcattgactacgaggaactgcgcgagcagttgtcatccgtcagttcattcgagcggtttgaaatatttcccaaggagtcaagttggccaaaccacaacacgaacggagtaacagcggcttgtagccatgaaggtaaaagctctttttacaggaatctgctgtggttgactgagaaggagggctcctaccccaaactgaaaaacagctacgtgaacaaaaagggcaaggaggtcctggtgctctggggaattcaccatccgcccaattccaaagagcagcagaatttataccaaaatgagaacgcctacgtttctgtcgtcacgtcaaattataaccgacgctttacacctgaaatagctgagagacccaaggtgagagatcaggctgggaggatgaattactattggactctgctaaaacctggagacactataatcttcgaagccaacgggaacctgattgcccctatgtacgcatttgctttatcccgagggtttggaagcgggatcattacttcaaatgcttctatgcacgagtgcaataccaaatgccagacacctttaggcgctatcaattcatctctgccttatcagaacattcacccagtgacaataggagagtgtcctaagtatgtccgctccgcgaagcttcgtatggtcacaggcctcaggaataacccaagtatccagtcgagaggcctttttggtgccatcgctggctttatcgaaggagggtggaccggcatgattgatgggtggtatggataccatcatcagaacgagcaaggctcaggttacgccgcggaccagaagtccacgcaaaatgccattaacggcatcacgaacaaagtcaacaccgttatcgagaagatgaatatacagttcacagccgtaggcaaagaatttaataaactcgaaaagcggatggagaatttaaacaaaaaagtcgatgatggatttctcgatatctggacttataacgccgaacttctagtgctgcttgagaacgagagaacgcttgattttcacgacagtaacgttaaaaacctgtacgaaaaggtaaagtcccaactgaaaaacaatgccaaagaaattggaaacggttgctttgaattttaccacaagtgcgataatgagtgcatggaaagtgtaagaaatggcacgtatgactatcccaaatactccgaagaaagcaagctcaatcgtgagaaggtggatggtgtgaagctggaatcgatggggatttatcagatcctagctatctattcaacagtcgcctctagtcttgttcttcttgtatctcttggagccatctcattttggatgtgttcaaacggatccctgcagtgtcggatctgtatc

SEQ ID NO: 456 - DNA, 1695 bp, Influenza A virus
  misc_feature (1)..(1695): Codon Optimized Sequence Encoding H1 Hemagglutinin
atgaaggctaacctgctggttctactctgcgcactcgcagctgcggacgccgacacaatttgtattggatatcacgctaacaatagcaccgataccgtagacaccgtactggaaaagaatgtgacggtcacacactcagtaaatctcctggaagacagccataatggcaagctgtgtagattaaaagggattgctcctctccagttgggcaaatgtaacatcgccggttggctgctggggaaccccgagtgcgacccattgctgcccgtaaggagctggtcctatatagttgagacacccaattctgagaatggcatctgctaccccggagattttatcgattatgaggagttgcgtgagcagctctctagcgtgagctcgtttgaaagatttgaaatttttccgaaagaatctagttggcccaaccacaatacgaacggagtgactgccgcctgctcccacgagggaaaatcctcattttacaggaacttactctggcttactgagaaggaaggtagctacccaaagctcaagaacagctacgtcaacaagaagggcaaggaagtcctggtcctgtggggaatccatcatccgccaaactccaaggagcaacagaatctatatcagaatgagaatgcctacgtttcagtggttacgtctaattataaccgcaggtttacccccgagatcgctgagcgccccaaagttagagaccaggcagggcgcatgaactactattggaccctcctgaaacctggcgacacaattatcttcgaggcaaacggtaatctcatcgcgcctatgtacgcttttgcccttagccggggttttggatcaggcatcataacttctaacgcctctatgcacgaatgtaacaccaagtgtcagacccccctaggagctatcaacagctcgcttccttaccagaacattcatcccgtgaccataggtgagtgtccaaaatacgtcaggagtgcaaaactaaggatggttaccggactccggaataacccttcgattcagtcgcgcgggctctttggagcaatcgccgggttcatcgaaggcgggtggaccgggatgattgacggttggtacggctaccatcaccaaaacgaacaaggctcaggttatgcagctgaccagaagtccactcagaatgccataaatggcattaccaacaaagttaatacagtcattgagaagatgaatatacagttcaccgcggtgggcaaagagttcaacaaactggagaaacgtatggaaaacttgaacaaaaaagtggacgatgggttcttggacatctggacgtataatgccgagttattagtgctgctggaaaatgaaagaacgttagacttccacgactctaatgttaaaaatttgtacgaaaaggtcaaatcccaactgaaaaataacgccaaggaaataggcaatggctgttttgaattctatcataagtgcgataacgagtgtatggagagtgttcgcaatggtacatacgactaccctaaatactccgaggaaagtaagctgaacagggaaaaggtcgatggagtcaagctggaatccatggggatttatcagatcctggccatttatagcactgtagcctcctccctggtgctgctggtatcactcggcgcaataagcttctggatgtgttctaacgggagcctgcaatgcagaatatgcatt

SEQ ID NO: 457 - DNA, 1695 bp, Influenza A virus
  misc_feature (1)..(1695): Codon Optimized Sequence Encoding H1 Hemagglutinin
atgaaagcaaacctcctcgtgttgctctgtgccctggctgcagccgacgccgacaccatatgtatcgggtaccacgccaataactccactgataccgtcgataccgtccttgagaaaaatgtgacagtcacacacagcgttaatttattggaggacagccacaacggcaagctctgtaggctgaaagggatcgcccccttacagctggggaaatgtaatatcgctggatggctgctgggaaaccccgagtgcgaccccttgctgcctgtgaggtcttggagctacattgttgagacccctaacagcgagaacggcatttgttaccctggcgacttcattgactacgaggagctgagggaacaattgtcatctgtcagctcatttgagcgattcgagatctttcccaaggaatcgtcatggccaaatcacaacacaaacggggtgaccgcggcttgctcacatgaaggaaagagctccttttaccgaaatcttctgtggctgacggagaaggaaggatcatacccaaaattgaaaaactcctatgtgaacaagaaaggtaaagaggtccttgttttatggggcattcaccacccacctaactcaaaagaacagcaaaacctgtaccagaacgagaatgcatacgtttcagtagtcacctctaactataataggagattcacccccgaaatcgccgagaggccaaaggtacgggatcaggctggcaggatgaattactattggaccctacttaaacctggagacacgatcatcttcgaggcaaatggaaacctcatcgcccctatgtatgcctttgcccttagccgagggtttggatcagggataataacctctaacgccagtatgcacgaatgcaatacgaagtgtcaaacccctctgggagcaataaattcttcccttccttatcagaacattcaccccgtcacaattggagagtgccccaaatacgtcaggtccgccaaactgagaatggttaccggcttgcggaataatccgagcattcagagccgcggattatttggtgctattgctggctttatcgaaggagggtggaccggaatgatcgacgggtggtacggctaccatcatcagaacgagcagggtagcggttacgctgccgatcagaaatccactcagaatgccatcaatggcattactaacaaagtaaatactgtgattgaaaagatgaacatccagtttaccgcagtaggaaaagagttcaacaaattggagaaaaggatggaaaacctcaacaaaaaagtcgacgatggattccttgatatttggacatacaacgctgagctgctagtgctgctggagaacgagcgaacactcgatttccatgatagcaacgtcaaaaacctgtacgagaaggtcaaaagccagctgaaaaataacgctaaggagattgggaatggctgtttcgaattctaccacaaatgtgataatgaatgcatggagagtgtgcggaatgggacatacgactacccaaaatattctgaagagagtaaacttaatcgagagaaagtggatggtgttaaacttgagtctatgggcatttaccagatcctggcaatttacagtaccgtcgcttcttctttggtcctactagtgagcctcggagcaatcagcttctggatgtgtagtaacgggagccttcagtgtcgaatttgcatc

SEQ ID NO: 458 - DNA, 1695 bp, Influenza A virus
  misc_feature (1)..(1695): Codon Optimized Sequence Encoding H1 Hemagglutinin
atgaaagctaatctgctcgtactgctctgcgctctggctgccgctgatgccgacaccatctgtattggatatcacgcaaacaattctactgataccgtggacaccgtgctcgagaaaaacgtgaccgtgacgcattccgttaatctgctggaagattcacacaacggaaagctgtgtagactgaagggaatcgccccactgcaattgggtaaatgtaacattgcaggatggcttctgggtaatcctgaatgcgatccactgctccctgttagatcatggtcatatatcgtcgaaacaccgaattctgaaaatggtatttgctaccctggcgatttcatcgactacgaagagctgagagagcagctatctagcgtgagtagcttcgaacgcttcgaaatttttcccaaagagagctcttggccgaaccacaataccaatggcgtgaccgccgcatgcagccatgagggcaaatcttctttctacagaaatctactttggctgaccgaaaaagagggaagttacccaaagctgaaaaattcctatgtcaacaaaaaagggaaggaggtacttgtgttatggggaattcaccacccccctaactccaaggagcagcagaacctgtatcagaatgagaacgcgtatgtttcagtggtcaccagcaactataatcgtcggttcacccctgagatcgccgaacggcccaaggtgagagatcaggctggaagaatgaattactattggaccttgctgaagcctggggataccatcatctttgaagctaatggaaacctgatcgcgcctatgtacgcattcgccctatcccgtggcttcggttccggcattatcacctcaaatgcctcaatgcacgagtgcaacactaaatgtcagaccccgctgggtgccatcaactccagccttccctaccaaaacatacatccagtgacgattggcgagtgcccaaagtacgtccgctctgccaagctacgcatggtcacgggcctgcgaaataacccctctatacaatcccgtgggctgtttggcgcgattgccgggttcatcgagggaggatggacaggtatgatcgatggctggtacggataccatcatcagaacgaacagggctccggctacgctgcggaccagaagtctacgcaaaacgcaattaatggaatcacaaacaaggtgaacactgtgatcgagaaaatgaatattcagtttaccgccgtcggtaaagaattcaataagctcgagaagagaatggagaacttgaacaaaaaagtggatgatgggtttctcgatatttggacatataacgcggaactcctggtgctgctcgagaatgagcgcaccctggattttcacgactctaacgtcaagaatttatacgagaaagtaaaatcccagctgaagaacaatgctaaagaaattggcaacggatgtttcgagttttatcataaatgcgataatgagtgcatggagagcgtgcgcaatggaacatacgactaccctaaatacagcgaggaatctaagctgaatagagagaaggtagacggagtcaagctggaatctatgggaatatatcaaattttagctatttactccacagttgcttcatccctggtcttactggtttccctcggcgcgatctcgttttggatgtgcagtaatggctcccttcagtgtcgaatctgcatc

SEQ ID NO: 459 - DNA, 1695 bp, Influenza A virus
  misc_feature (1)..(1695): Codon Optimized Sequence Encoding H1 Hemagglutinin
atgaaagctaatctgttggtgctgctctgcgctttggccgctgccgatgcagataccatctgtatcggctatcacgcgaacaattccacagatacagtggacaccgtcctggagaaaaatgtgaccgtgacccactctgtcaacctgctcgaagacagccataacggcaaactgtgtagactgaagggcattgcacctttacagctgggcaagtgcaatatagctggatggctcctcggcaatcccgaatgcgaccctctactgcccgtgagaagctggtcatatatcgttgaaaccccgaattccgagaatggaatctgctatcccggagatttcatcgactatgaagagctcagggaacagctgtcctctgtatcctcctttgaacgttttgagattttcccaaaggagtcatcttggcctaaccacaacacgaacggggtaaccgcagcctgcagtcacgaaggtaagagcagcttttacaggaatctgctgtggctaaccgagaaagagggcagttatcctaaactgaaaaattcatatgtgaacaagaaaggaaaggaagtgctggtgctttggggaatccaccatccgcccaacagcaaggagcagcagaacctataccagaacgaaaacgcttatgtgtcagtggtgactagcaactacaaccgacgttttacccccgagattgccgagcgacccaaggtgagagaccaggccggtcgcatgaactactactggacactccttaagccaggcgatacaatcatatttgaagctaacgggaacctcattgctcctatgtacgctttcgcgctgtctaggggtttcggctccggaataattacaagcaatgcttccatgcacgagtgcaataccaagtgtcagactcccctgggggccattaacagcagtctgccataccaaaatattcatccagtaacaatcggcgagtgtccaaagtacgtgcgatctgccaagttacgaatggtgaccggcctgcgcaataacccctcaattcagtctaggggcttattcggggctatcgccggcttcattgagggaggatggacaggaatgatcgatggatggtacggctaccatcaccagaatgagcaaggcagcggttacgctgccgaccagaaatcgacacagaatgctatcaatggaatcactaacaaagtcaacacggtgattgaaaagatgaatatccaattcactgcagtgggcaaggaattcaacaaattagagaagcggatggagaacctgaataaaaaagttgatgacggtttcctggatatctggacatacaatgcagaacttctcgtcctgctcgagaacgagcgaactctcgattttcacgattctaatgtcaaaaatctgtatgaaaaggtgaagtcccagctgaagaacaacgcaaaggaaatcgggaatggatgcttcgagttttaccataaatgtgataacgagtgcatggaaagcgtccgaaatggcacttatgactatccaaaatactcagaggagagtaaacttaaccgcgagaaggttgatggcgttaaactggaatccatgggcatttaccagatcttggctatctatagcacggtggcttcttcgctggtgctcttggtcagtctcggtgccatctcattctggatgtgttcgaacggatctcttcaatgccgaatctgtata

SEQ ID NO: 460 - DNA, 1695 bp, Influenza A virus
  misc_feature (1)..(1695): Codon Optimized Sequence Encoding H1 Hemagglutinin
atgaaagccaaccttctagttttactatgtgctctcgctgctgctgacgccgacactatttgtattggatatcacgcaaataattccacagatactgtcgacaccgttttggaaaagaacgtgactgtcactcactcagtcaacctgctcgaagattctcacaatggcaaattatgccgcctcaagggaatcgctccgctccaattgggaaaatgtaacatcgcaggatggctcctcggcaatcctgaatgcgaccctctcctgcccgtccgctcttggtcatacatagtggaaactcccaacagtgaaaatggaatatgttaccccggtgacttcatcgactatgaggaattgcgcgagcaactgtcctcagtttcctcgttcgaaagatttgagatcttccccaaggagtcctcctggcccaatcacaatacgaatggcgttacggcagcctgctctcatgaggggaaatcctcattctaccgcaacctgctctggctgacagagaaggaggggtcctaccctaagctcaaaaattcctatgtgaataaaaagggcaaagaagtactggtcctgtggggcattcaccatcccccaaatagtaaagaacaacagaacctctaccagaatgagaacgcttacgtgagtgtggtcactagcaactacaacaggagattcacacccgagatagcggaacgacccaaggtccgcgatcaggctggtcgcatgaattactactggaccttgctgaagcccggagatacgattatttttgaggccaatggcaatcttatcgccccaatgtacgcctttgcactcagccgtgggttcggaagtggaatcataacttcaaatgcctccatgcatgagtgcaatacaaaatgtcagacccctctcggagccatcaactcatcactgccataccagaatattcaccctgttacaattggagagtgtccaaaatacgtcagaagtgcaaaactgcgcatggttaccggactacgtaacaacccgtccatccagtcaagagggctgtttggagccatcgcaggatttatagagggaggctggaccgggatgattgatggctggtacggctaccatcaccaaaatgagcagggaagtgggtatgctgccgaccagaaatccacccaaaacgcgatcaatggtatcaccaacaaagtcaataccgtgatcgaaaaaatgaacatacagtttacagcagtgggaaaggaattcaataaacttgagaaacgcatggagaatctgaataaaaaggtcgacgatggcttcctagatatttggacctacaatgcagaattactggtattgttggagaatgagcggaccctcgacttccatgattcgaacgttaaaaacctctacgagaaggtaaagtcgcaactgaaaaacaacgctaaggagatcgggaacggctgcttcgaattttatcacaaatgcgacaacgaatgcatggaatcagtgcgaaatggcacctatgattatccaaagtattcggaggagtcaaagctgaatagagagaaggtggatggtgtgaagttggagagtatggggatttaccagatcttagcaatctattccacggttgctagttccctcgtgttacttgtgagcctgggtgcgatcagtttctggatgtgcagtaacggttcactgcaatgcagaatctgcatc

SEQ ID NO: 461 - DNA, 1695 bp, Influenza A virus
  misc_feature (1)..(1695): Codon Optimized Sequence Encoding H1 Hemagglutinin
atgaaagctaatctcctggttttgttgtgtgcactggccgctgccgacgccgacacaatctgcataggataccatgctaacaacagtacagatacagttgacaccgtgctggaaaagaatgttactgtaacccatagcgttaacttgctagaggactctcataatggaaagctctgtaggcttaaagggatcgcccccttacaattgggcaagtgcaatatcgccggatggctgctcgggaaccctgagtgtgatccattgctgccagttcgttcctggtcttacatagttgaaacgccaaactccgagaacgggatctgttacccaggtgacttcattgattacgaagaactgagagaacagctaagttctgtgtctagcttcgagagattcgagatctttcccaaagagtcaagttggcctaaccacaataccaacggggttaccgcggcttgctcccacgaaggtaaaagctcattctaccggaaccttttgtggctcactgagaaagagggtagctacccaaagctcaagaactcctacgtgaataagaaggggaaggaggtgctcgttttatggggtatccaccacccccctaatagtaaggaacagcaaaatctctatcagaacgaaaacgcatatgtctcggtggtgacctcaaactataatcggagattcactccagagatcgccgagagacccaaagtccgggaccaggcaggaaggatgaactattattggactttactgaagcccggggatactattatttttgaagccaatggcaatcttattgcccccatgtacgctttcgccctgagtcgcggcttcgggagtggcattattacttccaatgcctcgatgcatgagtgcaatacgaagtgtcagaccccattaggagctatcaatagcagcctgccatatcagaacatccacccggtgactattggagagtgtccaaagtacgttaggtccgccaagttacggatggtaacaggcctccgcaataatccttctatccaaagtcgggggctgtttggagcaatcgccggcttcatcgagggaggttggactgggatgattgacggatggtatgggtaccatcatcagaatgagcaaggcagtggctacgcagccgaccagaagtcaacccaaaacgccatcaatggaatcacgaataaagtgaacacagtgatcgagaagatgaacattcagttcactgcagtggggaaggaatttaacaagttggagaagagaatggagaacctgaacaagaaggtagacgatggattcctagacatatggacatataatgccgagctgttggtcctcctcgaaaacgaaagaacactggactttcatgacagtaacgtgaagaatttgtatgagaaagttaagtctcaactgaaaaacaacgccaaagaaatagggaacggttgtttcgagttctatcataagtgcgataacgagtgcatggagtctgtgcggaatggcacgtacgattatccaaaatactccgaggagtccaaacttaacagagagaaagtggatggcgtgaaacttgaaagcatgggcatttaccaaatcctcgccatttacagcacagtcgcttctagtctagtactgcttgtatcactcggcgccatatcattctggatgtgtagtaatggcagcctgcagtgccgaatttgcatt

SEQ ID NO: 462 - DNA, 1695 bp, Influenza A virus
  misc_feature (1)..(1695): Codon Optimized Sequence Encoding H1 Hemagglutinin
atgaaagccaacctgctcgtactcctgtgtgccctggctgccgctgacgccgatactatttgcatagggtatcacgccaataattcaactgacaccgtcgataccgttcttgagaagaacgtgaccgtcacacattcagttaaccttcttgaggactctcataatggtaaattgtgtcgcctcaagggtatcgcaccgctacaactaggcaagtgtaatatagcagggtggttgttgggaaaccctgagtgtgacccgctgctgcccgttcgcagttggtcttacatcgtcgagacaccaaactctgagaacgggatttgctatccaggggattttatcgactatgaagagcttcgcgagcagttgagcagtgtttcctcttttgagcgttttgaaattttcccgaaagagagtagctggcctaaccataacacaaacggggtcaccgcagcttgctctcatgaggggaagtcaagcttctatcggaatctgctgtggctgacggaaaaagaaggctcgtacccaaagctaaaaaattcatacgtgaacaagaaggggaaagaggtcctggtcctgtgggggatccaccatccacctaatagtaaagagcagcaaaatttgtaccaaaacgagaatgcgtacgtgagcgtagtgacatcaaactacaaccgccgcttcactcctgagattgctgaacggcccaaggtgcgtgatcaggccggcaggatgaactattattggactttgctaaaacctggggatactataatttttgaggcgaatggcaatctaatcgcaccgatgtatgccttcgccttgagccggggcttcggcagtgggattattaccagtaacgcctccatgcacgaatgtaacacaaagtgtcagactccattaggggcaatcaactcgtcacttccgtatcaaaatattcaccctgtgaccatcggcgagtgtccaaaatacgttagaagtgccaagctgagaatggtgacgggtctccggaacaatccctcaatccaatcaagggggttatttggcgctattgctggtttcattgaggggggatggaccggaatgatcgacggctggtacggatatcatcatcagaacgaacaggggtccggctatgctgccgaccagaagtccactcagaacgcgatcaatgggatcaccaacaaggtcaacaccgtcatcgaaaagatgaatattcagtttacagccgtcggaaaggaattcaataagttggagaaacgcatggaaaacttaaacaagaaagtggacgacggattcttagacatatggacttataacgcagagctgcttgtactcctggagaatgagcgaaccttggattttcatgattcaaacgttaagaacttatatgagaaggtgaagtctcaactcaaaaacaatgccaaagaaatcgggaatgggtgcttcgaattctatcataaatgtgataacgagtgtatggagagcgtgcggaatggaacttatgactaccccaaatacagcgaagaaagcaagttgaacagagagaaggtggatggcgtgaagctggaaagcatggggatttaccagattcttgcaatctattctactgttgcatccagtctagttctgctcgtctctctgggggcaatcagcttttggatgtgctctaatggttccctgcagtgccgtatctgcata

SEQ ID NO: 463 - DNA, 1695 bp, Influenza A virus
  misc_feature (1)..(1695): Codon Optimized Sequence Encoding H1 Hemagglutinin
atgaaagcaaaccttctggtactgctctgcgccttagccgccgctgatgcggacacgatttgtattggctatcacgccaataattcaacagatactgtcgacacagtcttggagaaaaatgtgactgtaacccattctgtcaatctgctcgaggattcacacaatggaaaactgtgtcggcttaaaggaatcgctcctctgcagttgggcaagtgtaatatagctggctggctgttaggaaacccagaatgcgatcctctcttacctgtgcgatcctggtcttacatcgttgagacaccgaacagcgagaatggtatatgctacccgggtgactttatcgattatgaagaattgagagaacagctgtcaagcgtcagctctttcgaacgattcgagatctttcccaaagagtcaagctggcctaaccacaatacaaatggagtgacagctgcgtgttcccatgaaggcaagagttctttctaccgaaacctgctttggctgaccgagaaggagggatcataccctaagttaaaaaattcatacgtcaacaagaagggaaaagaggtactagttctttggggtattcaccacccacccaactccaaagagcagcagaatctgtatcaaaatgaaaacgcgtacgtctccgtggtgacctcgaactacaatcgacgattcactcccgaaatcgctgagaggcccaaagtccgggatcaggccggacgcatgaattattactggactctactaaagccaggtgatacaattatcttcgaagccaatggcaatcttatcgctcccatgtacgcattcgctctgagccgtggttttgggtctggaatcatcacctccaacgcttctatgcatgaatgtaatacaaaatgccagactccgttaggggcaatcaacagttcactgccataccaaaacatccaccccgtgactattggggagtgcccaaagtatgtccggagcgccaaactccggatggtcaccggcctacgcaataaccccagtatccagtctaggggattgttcggtgctatcgcaggttttattgagggcggctggacaggaatgatcgacggatggtatgggtatcatcaccagaatgaacaaggctccgggtatgcggctgaccaaaaatccacgcagaacgcaatcaacggaatcaccaataaagtgaatactgtgatagaaaagatgaacattcagttcacggctgtaggcaaggagttcaataagctggagaagagaatggagaacctaaataagaaggtcgatgacggcttccttgacatctggacttacaatgcagaactgctggtactgcttgagaacgaacgcaccctggatttccacgactctaatgtgaagaacctatacgaaaaagtgaagtcccagctgaaaaacaatgctaaagagataggcaacggctgcttcgaattctatcataaatgcgacaacgagtgcatggagtcagtccgaaatggtacgtacgattacccaaaatattctgaagagtccaagctaaatagagaaaaggtggacggcgtaaaactcgagtccatgggcatctaccagattctggccatctacagtacggtggcttcatcgcttgtactcctggtgagcctaggggccatctctttttggatgtgttctaacggttccctgcagtgccgcatttgtatt

SEQ ID NO: 464 - DNA, 1695 bp, Influenza A virus
  misc_feature (1)..(1695): Codon Optimized Sequence Encoding H1 Hemagglutinin
atgaaagctaacctgctggtactcttatgcgctctggccgctgcagacgccgataccatctgtatcgggtatcatgccaacaatagcaccgacaccgtggatacagtcctagaaaagaatgtgaccgtcactcactcagtgaacctattagaagattcccacaacggcaagttgtgtcgcctcaaaggcatcgccccactgcaacttgggaaatgcaacatagccgggtggctgctgggcaacccagagtgcgatcccctgttgccagtgcgcagttggtcatatatcgtggagactccaaattcagaaaatgggatttgctatccaggggacttcatcgactacgaagaactgcgcgaacagctgtccagcgtgagttccttcgaacgatttgaaattttcccaaaggagagcagctggcctaaccacaacacgaacggagtgactgccgcttgcagccacgagggaaagagctctttctaccgcaaccttctgtggttgacagagaaggaagggagctaccccaaactgaagaactcctacgttaataagaaaggtaaggaagtgctagtgctctggggtatccatcatccaccaaatagcaaagagcaacagaatctgtatcagaacgagaacgcttacgtgtcagttgtcacttccaactataaccgccggttcactccagagatcgctgagcgccccaaggtgcgcgatcaggctggccgcatgaactattactggaccttgctgaagccaggggacacaattatctttgaggccaatggaaatctcatcgcaccgatgtacgcctttgccctttcccggggcttcgggtctggcatcattacctcgaatgcttcgatgcacgagtgcaacaccaagtgccaaactcccttgggagctattaattcttcactcccataccagaatattcacccagttacaatcggcgagtgtccaaagtacgtgcgttccgcaaaactgcggatggttacaggtctgcgaaacaatccaagtatacagagtagaggactttttggagctattgccggattcatagaagggggctggaccggaatgattgacggttggtacggctaccaccatcaaaacgaacaggggtccggatacgccgcagaccaaaaaagtacccaaaatgctattaatggcataaccaataaagtcaacacggtcattgaaaagatgaacatccagttcactgctgtgggaaaggagttcaataagctggagaaacgaatggagaacctcaacaaaaaagtagatgacggctttttggacatctggacctacaatgcagagcttctggtgctattagagaacgaacgtacattagactttcacgactccaacgtcaaaaacctgtatgagaaggtgaaatcccagcttaagaataacgcaaaggaaatcgggaacggctgctttgaattctatcacaagtgtgacaatgagtgtatggagagcgtgcgcaatgggacctacgactatcctaagtactcagaagagtctaaactgaaccgtgaaaaggtcgacggcgttaagctggagtctatggggatctatcagatccttgcaatttattccaccgtggcgtcttccttggttttgctagtgagtttaggtgctatcagtttctggatgtgctccaatggctccctgcaatgtaggatctgcatt

SEQ ID NO: 465 - DNA, 1695 bp, Influenza A virus
  misc_feature (1)..(1695): Codon Optimized Sequence Encoding H1 Hemagglutinin
atgaaggccaacctcctggtcttgctgtgcgccctggctgctgccgatgcagataccatttgcatcggctatcacgccaacaattctacagataccgtggatacagtactcgaaaaaaatgttactgtgacgcactcagtcaacctgttggaagactcgcacaatggcaaactgtgcaggctgaaaggcattgcccccctacagctggggaagtgcaacattgcaggctggctgttgggaaaccctgaatgtgatccattgctcccagtgcggtcctggtcttacatcgtggagacaccaaacagcgagaatgggatctgttaccctggcgattttatagactacgaggagctcagggagcagctcagctctgtgtcgtctttcgagcgctttgagatttttcctaaggagtcctcctggccaaaccacaacacgaatggagtgacagccgcctgtagccacgagggcaagtcctcattctatagaaacttgctttggctaactgaaaaggagggcagctaccctaaactgaaaaatagctatgtgaacaaaaaaggcaaagaagtgctcgtcctgtgggggatccatcatcctcctaactcaaaggagcagcagaacctgtatcagaatgaaaacgcttacgtgtctgtcgtgacttcaaattataaccggaggttcactcccgaaattgccgagagaccaaaggtcagggaccaggcaggccgcatgaattactattggacacttctgaaaccaggcgacacaattattttcgaggcaaacgggaaccttatagccccaatgtacgccttcgcactatcaagaggcttcggttccggcatcattacaagcaacgcgagcatgcatgaatgcaacaccaagtgccaaaccccactgggtgcaattaatagttccctgccatatcagaatatccacccggtgacaattggagagtgccctaagtacgtgaggagcgctaagttaagaatggtgacgggactgagaaacaacccttccattcagtcccgaggactttttggagcaatcgccggctttattgaggggggctggacggggatgattgatggctggtatgggtatcaccaccagaatgaacagggaagtgggtacgctgctgatcagaagtcaactcagaatgccatcaacgggataacaaataaggtaaatactgtgattgaaaaaatgaatatccagttcactgccgttgggaaggagtttaacaagcttgagaaaaggatggaaaacctgaataagaaggtagatgacggattcctcgatatatggacctacaacgctgagctgctggttttgctagagaacgaaagaactttggattttcatgattctaacgtgaagaacttgtacgaaaaagtgaaaagtcagcttaaaaacaacgcaaaggagattgggaatggctgctttgagttttatcacaagtgcgacaatgaatgtatggagagcgtgaggaacggcacgtatgactaccccaagtacagtgaggaatccaagctgaaccgagaaaaggtcgacggcgtgaagctggagtctatgggaatctatcagattctcgcaatttactcaactgtcgcatcatccctagtgctcctggtgagcctgggagccatttctttctggatgtgtagcaatggtagtttacaatgcagaatctgtatt

SEQ ID NO: 466 - DNA, 1695 bp, Influenza A virus
  misc_feature (1)..(1695): Codon Optimized Sequence Encoding H1 Hemagglutinin
atgaaggcaaatctgctggtcttactgtgcgctctggccgctgctgatgctgatacaatctgtattggctaccacgccaataactccactgatacagtggatactgtgctggaaaaaaatgttacagtcacacattcagtgaacctcctagaagacagccataacggaaaactctgccggctgaaaggtatcgcacctttgcagctaggaaagtgcaatattgcgggctggctgcttggtaatcccgagtgcgacccactcttaccagtgagaagttggagctatatcgtagagacccccaactctgagaatggaatctgttatccaggcgactttattgattacgaggaactgcgcgagcaactctcttctgtgtcttcattcgagaggtttgaaatcttccctaaggagtcgtcttggcctaatcacaataccaacggggtgaccgccgcttgcagccacgaggggaagagttctttttaccgaaatcttctgtggctaacagaaaaggaaggatcatacccaaaattaaagaatagctatgtaaacaagaagggtaaggaggttcttgtcttatggggcatacatcatccccccaactctaaggaacaacagaatctatatcagaacgagaatgcttacgtgagtgtggtgaccagtaattataatagaagattcactcctgagattgccgaaaggcctaaagtgcgcgaccaagcgggacggatgaactactactggaccttgctcaagccgggtgacacaattatttttgaagcaaatggtaatctcattgcaccaatgtatgcgtttgccctgagtcgtggatttggcagcggaataataacttcaaacgccagcatgcacgaatgcaatactaaatgtcagaccccactgggggcaatcaactcctcactgccatatcagaacatccaccccgtgaccattggtgagtgccctaagtatgttagatcagcgaagcttcggatggtaacaggacttagaaataatccgagcattcaaagccgcgggctgtttggagccattgcagggtttatcgaagggggttggaccggcatgattgatggctggtatggataccaccatcagaacgaacaaggcagcgggtatgcagctgaccaaaagtctacccagaacgccatcaatggaatcacgaacaaggttaatacagtgattgagaagatgaatattcagtttacagccgttggcaaggagttcaacaagctggagaagcgaatggagaacttaaataaaaaggtcgacgacggcttcctggacatttggacatacaacgctgaactgttggtgcttctcgagaatgaacgaactttagattttcacgatagcaacgttaaaaacttatatgagaaagtgaagtctcagctcaagaataatgccaaggagataggtaatggttgcttcgaattctatcacaagtgtgacaacgaatgcatggagagtgttagaaacggtacatacgattatcccaagtatagtgaggagtccaaactcaatagggaaaaggtggacggggtgaagctcgagagcatgggcatttatcagatccttgcaatatactcaaccgtagcatcttctctcgttcttctggtgtccctgggcgctatttctttttggatgtgcagtaatggcagccttcaatgtagaatttgcatc

SEQ ID NO: 467 - DNA, 1695 bp, Influenza A virus
  misc_feature (1)..(1695): Codon Optimized Sequence Encoding H1 Hemagglutinin
atgaaggccaatctcctggtgcttctatgtgcactggccgcggccgatgccgacaccatttgcattggctatcacgccaataattccactgacacagttgataccgtgctcgaaaaaaacgtaaccgtgacccattccgttaacctgcttgaggattctcacaacgggaaactctgcagactgaagggcatcgcccccctgcagctgggaaaatgcaatattgccggctggctcttaggtaacccagaatgtgatccattactgccggtcagaagctggagctacatcgtggaaacccccaactctgagaatggaatctgttatcccggagattttattgattacgaggagctccgcgaacagctatcctctgtatcttcttttgagagattcgagattttccccaaggagagcagctggccaaaccacaacactaatggtgtcaccgccgcctgctcccatgaaggaaagtccagcttttatcggaacttactgtggctgacagagaaggagggctcttaccccaagctgaagaacagctatgtcaataaaaagggcaaggaagtcctagtgttgtgggggatccaccatccacctaacagcaaagagcagcagaacctctaccagaatgagaatgcgtacgtttctgtggtgacttcaaactataaccgccgattcacacccgagatcgcagagagacctaaagtcagggaccaagcggggagaatgaactactactggaccctcttgaagcccggcgataccattatttttgaggctaacggcaacctgatcgcccccatgtatgcattcgctctgagccgtggcttcggatctggtattataacctcaaacgcaagcatgcatgaatgtaacaccaaatgccagacccccctgggggccatcaacagcagtctgccataccagaacatccaccctgtcaccattggtgaatgccccaagtatgtccgatcagcgaaactgcggatggtcacggggctgcgaaacaatccttcaatccagagccgaggactttttggagctatcgccggattcattgaaggcggctggacagggatgatcgacggttggtacgggtatcaccaccagaacgagcaaggcagtggctacgcagctgaccagaaatccacccaaaacgccattaacgggatcactaacaaagtgaacacggtcatcgagaagatgaatattcaattcactgccgttggcaaagagtttaataagttggaaaagcgcatggagaatctaaacaaaaaggttgacgatggtttcttggatatctggacatataatgccgagctgttagtcctgttagaaaacgagagaacccttgattttcatgatagcaacgtcaaaaacttatacgagaaggtgaaaagccagcttaaaaataatgccaaagagataggaaatggctgttttgagttctatcataagtgcgataacgagtgcatggagtccgttcggaatggtacctacgattacccgaagtactctgaggagagcaagttgaatcgggagaaagttgatggcgtcaagctcgaatccatgggtatctaccagatattagctatttactccacagtcgcatctagcctggtcctgctggtttcgctgggcgccatatctttttggatgtgttctaatggcagcttacaatgcaggatttgtatc

SEQ ID NO: 468 - DNA, 1695 bp, Influenza A virus
  misc_feature (1)..(1695): Codon Optimized Sequence Encoding H1 Hemagglutinin
atgaaagccaacctcctcgtgttgctgtgcgctttggccgctgccgacgccgacaccatctgtataggctatcatgcgaataatagcaccgacacagtagataccgttctggagaagaacgtgaccgtgactcacagcgtgaatctgttggaggactcccataatgggaagctgtgtagattgaaaggtattgcaccgctacaactcgggaagtgcaatatcgccgggtggctgcttggtaaccccgagtgtgacccactgctgccagttcgttcttggagttacatcgtggagactcctaatagcgagaatggtatctgctaccctggggacttcatcgattatgaggagctcagagagcagttgagttccgtgtcatcatttgagcggtttgagatttttccaaaggaaagttcgtggccgaaccataacactaacggagtcaccgccgcctgtagtcacgagggcaaatcttctttttaccggaatttgctgtggcttacagaaaaagagggctcctatccgaagctgaagaactcttatgtgaataaaaaaggaaaggaagtcctagtgctgtggggaatccatcatcctccaaatagtaaggagcagcagaacctatatcagaacgagaacgcatacgtgtccgtggtcacgtcaaactacaaccggaggttcactcccgagatcgccgaaaggcctaaggttcgggatcaggctgggcgcatgaactactactggactttactgaaaccaggagacaccattatcttcgaggctaacggcaatctcatagctccgatgtacgcctttgccttgagtcgcggattcggaagtggtatcattactagcaatgcctcaatgcatgagtgtaacacaaaatgccagacccccttgggagcaattaactcatctctaccatatcagaacatccaccctgtcactataggggagtgtcccaagtatgtcagatccgccaagttgcggatggtaaccgggctgcggaataacccctccatccagtcccgtggcctttttggcgccattgcgggatttattgagggaggctggacgggcatgattgatggctggtatggttatcaccaccagaatgaacaggggtctggttatgctgccgaccagaagagtacccaaaacgccatcaatggaattacaaacaaggtgaatacagtgatcgaaaaaatgaacatccagtttactgcagttggtaaagaattcaacaaactagaaaagcggatggagaacctcaacaagaaggtcgatgacggctttctggacatctggacatacaacgccgaacttctagtgcttctggagaatgagcgcacactggattttcacgactcaaatgttaagaacctctacgaaaaggtgaagtcccagctcaaaaacaacgccaaggagattggcaatggctgttttgaattttaccacaaatgcgacaatgaatgtatggagtccgtccggaatggcacctatgactatccaaagtattctgaggaatccaagctgaatcgggaaaaagtggatggtgtgaaacttgagtcaatgggaatttatcagatcctggccatttacagtacggtggcctcctcactggtgctactggtaagtctgggagcaatttcattctggatgtgctccaatggttcactgcagtgcagaatctgcata

SEQ ID NO: 469 - DNA, 1695 bp, Influenza A virus
  misc_feature (1)..(1695): Codon Optimized Sequence Encoding H1 Hemagglutinin
atgaaggctaacctgctggtacttctgtgtgcgctcgcggcagctgatgccgacacgatctgtattggatatcatgcgaacaatagcacagacaccgtggatacagttctggaaaagaacgtgactgtcacgcactccgtcaacttactagaggactctcacaacgggaagctctgcagactgaagggaattgcacccttgcagctgggtaagtgtaacatcgctggatggctacttggtaaccccgagtgtgaccctctcctgcccgtgcggtcctggagctacatagttgagacaccaaactctgagaacgggatctgctatcctggggacttcattgactacgaggagctgcgggagcagctctcctccgtctcgtctttcgaaaggttcgagattttcccaaaagaatcaagttggcccaaccacaacacaaatggtgttaccgccgcctgtagccatgaagggaaatcaagcttctaccgtaatctgctttggcttaccgaaaaagaaggaagctaccctaagttaaaaaactcttatgtcaacaaaaaagggaaagaagttttggtgctgtggggcatccaccaccctcctaattcgaaagaacagcagaacttgtatcagaacgaaaatgcctacgtgtccgtggtgaccagtaactacaaccgacggttcaccccggagatagcagagaggccaaaagtcagagatcaggctggcagaatgaactattactggaccctcctaaaacccggagacactattatatttgaggcaaatggtaatctgatcgctccaatgtatgctttcgccctctcccgcggattcgggtcagggataatcacctctaacgcttctatgcacgaatgtaacaccaagtgccaaactccccttggagccatcaacagttctctaccataccagaatatccatccagtgacgatcggcgaatgccctaaatacgtcagaagtgctaagctaagaatggttactgggctgagaaataatccgtccattcagagcagggggctgtttggagcgatcgctggatttattgaaggaggttggaccgggatgatcgatggctggtacggttatcaccatcaaaatgagcagggaagcggatacgccgcagaccagaaaagcacacagaacgctattaacggaatcactaataaggtgaatactgtcatcgagaaaatgaacattcagttcacagcagtgggcaaagagtttaacaagcttgaaaagaggatggagaatctcaacaagaaggtggatgacggcttcctcgacatctggacttataacgccgagctcctcgtcctgctcgaaaatgaaaggactttggacttccacgattcaaacgtgaagaatttgtacgaaaaggtgaagtcccagctgaaaaacaacgctaaggagatagggaatggctgtttcgaattctaccacaagtgcgacaatgagtgcatggagagtgttagaaatgggacgtatgactatcctaagtattcggaggaatcaaagttgaatcgagagaaggtggacggtgtgaagttagagtcgatgggcatctaccagattctggctatctattccaccgtggctagcagcttggtcctcctcgtatcattgggcgcaattagcttctggatgtgctccaacggttcccttcagtgcagaatctgtatc

SEQ ID NO: 470 - DNA, 1695 bp, Influenza A virus
  misc_feature (1)..(1695): Codon Optimized Sequence Encoding H1 Hemagglutinin
atgaaagcaaatctgctggtgctgttgtgcgcgctggcggctgctgacgcagacaccatttgcatcggctaccacgccaacaacagtactgatactgtggacacagttttagaaaagaatgtgaccgtaacacatagcgtaaacttgctggaagacagtcacaatggaaaactctgccggctgaagggaatcgcccctctacagctcggcaaatgcaatatcgccgggtggctattggggaatccagagtgcgacccacttctgcctgtgcgcagttggtcatatatcgtggaaacaccaaactccgaaaacggcatttgctatcctggagactttattgactacgaagagctaagagagcagctgagctccgtgtccagttttgagcgatttgagatcttcccaaaggagagctcttggccaaatcacaataccaacggagtgaccgcggcttgttctcacgagggtaaatcctccttttataggaacctgctgtggctgaccgagaaagagggatcttacccaaaacttaagaacagctatgttaacaagaagggaaaagaagtgcttgtgctgtggggtattcaccaccctcctaattccaaggagcagcagaatctgtatcagaatgagaatgcctacgtcagcgtggtcacctcaaattataacagacggttcaccccagagattgcggagcgtcccaaggtaagggaccaagccggacgcatgaactattattggactctgctgaaacctggtgatactatcatctttgaggccaatggcaatcttatcgcccctatgtatgcatttgccctatctcgcggatttgggagcggcatcatcacaagtaatgccagcatgcacgaatgtaataccaaatgccagacacctctgggcgctatcaacagcagcctgccttatcagaatatacaccctgtcaccatcggggaatgccctaaatatgttcgcagtgccaaacttcgtatggtgactgggctgcgcaacaacccatcaattcagagcaggggcctgttcggagcgattgccgggtttatcgagggagggtggacgggcatgatagatggctggtacggataccaccatcaaaatgaacagggcagtggctacgcagcggaccagaaatccacccagaatgctataaacggtatcacaaataaggtgaatacagtcatcgaaaagatgaatattcagttcactgcggtcggtaaggagttcaacaaactggagaagaggatggaaaatcttaacaaaaaagtggacgacggcttcctggatatatggacgtataatgcagaactgttagtgttactcgagaatgagaggactctcgacttccatgattccaacgtgaagaatctctatgagaaggtgaaatcccaactgaagaacaacgccaaagagatagggaatggatgcttcgaattctaccataagtgtgataacgagtgtatggagtctgtgcggaatggcacttacgactatccgaaatacagtgaggagtcaaagttgaaccgggagaaggtcgatggcgtcaagctggagagtatgggaatctatcagatcctcgcaatttactcaaccgtggctagctccctggtactcctggtctcacttggagccatctccttctggatgtgcagcaacggcagccttcagtgcagaatctgcatt

SEQ ID NO: 471 - DNA, 1695 bp, Influenza A virus
  misc_feature (1)..(1695): Codon Optimized Sequence Encoding H1 Hemagglutinin
atgaaggccaatcttttagtgctgttgtgtgcactggcggcagctgatgctgacaccatctgcatcggataccacgccaataacagcactgacacagttgacactgttctggaaaaaaacgtgacggtgacccactccgtcaatcttctggaggactcccacaacgggaagctgtgtaggttgaagggtatcgccccgttgcagctgggcaaatgcaacatcgcgggttggctgcttggcaatcctgagtgcgatccactgctacccgtacggtcttggtcatatatcgttgagaccccaaatagcgagaatggcatctgttatcctggcgatttcatcgactacgaagagctgcgagaacaactgagttcggtgtctagtttcgagaggtttgagatcttcccaaaagaaagttcctggcctaaccacaataccaacggggtaacggccgcttgtagccacgagggcaaatcaagcttttacagaaatctgctgtggctcacagaaaaagaagggagctatcctaaattaaagaattcatacgtgaacaaaaaaggaaaggaagtactcgtcctgtggggaattcaccaccctccaaattctaaagaacaacagaacttgtaccagaatgaaaacgcctatgtatccgtggttacctcaaactacaatcggcggttcacccccgaaatagctgagagaccgaaggttcgggaccaagcgggaagaatgaactattactggactctccttaagcccggtgatactatcatctttgaagccaacggaaaccttatcgccccaatgtatgccttcgcgttatcccgcgggtttggaagcggtattattacttcaaacgcgagcatgcacgaatgtaatactaaatgtcagacaccccttggcgccatcaatagcagtctgccataccaaaatattcaccccgtgacaattggcgagtgtccaaaatatgttagaagcgccaaactcagaatggttactggcttgcggaataacccgtccattcagtccagagggttatttggggcaatcgccggctttatagaagggggctggactggaatgatcgacggttggtacggatatcatcaccagaatgaacagggatcaggatatgccgcggaccaaaagtctacccagaacgccatcaacggcatcactaataaggtcaacactgtgattgagaagatgaatattcagttcaccgcagtcggcaaggaattcaacaaactcgagaaacgcatggaaaaccttaacaaaaaggtggacgatgggtttctggacatttggacctacaatgccgagctgctagtgctgctggaaaacgagcggactcttgatttccatgactctaatgtaaaaaacctttacgaaaaagttaaatcacaacttaaaaataatgccaaagaaatagggaacggatgtttcgagttctaccacaaatgtgataacgaatgcatggagagtgttcgcaacggaacatatgactatcctaagtacagcgaagagtcaaaactaaatcgggagaaagtcgacggcgtgaaactcgaatccatggggatttaccagatcctcgcaatctattctaccgtggctagctcgctggtgctgcttgttagtctgggagctatctccttttggatgtgtagcaatggaagcctgcagtgtagaatttgcata

SEQ ID NO: 472 - DNA, 1695 bp, Influenza A virus
  misc_feature (1)..(1695): Codon Optimized Sequence Encoding H1 Hemagglutinin
atgaaggccaacctgctggtcctgctgtgtgcactcgccgccgccgatgccgacactatttgtattggctaccacgctaacaactccacagatacagtcgatactgtgctggaaaagaatgttaccgtcacccatagcgtgaacttgctcgaggattctcataatgggaaactctgtcggttaaaggggattgcacctctccaactgggcaagtgtaacatcgcgggttggctgcttggaaaccctgagtgcgatcctctacttccggtcaggtcgtggagttacattgtcgagacccctaactcagaaaacggtatctgttatccgggtgattttatcgattacgaagagctcagagaacagctgtccagcgtgtcttcattcgagcgattcgaaattttcccgaaggaatcatcttggccaaatcataatactaacggggtgacggccgcatgttcacatgagggcaaatccagcttctaccgaaaccttttgtggttgacggagaaggagggctcttatcccaagctgaaaaacagctatgtgaacaagaaggggaaggaggtgctcgttctgtgggggatccatcaccctcctaacagcaaagagcagcaaaacctgtatcagaatgaaaacgcctatgtgtccgtggtgacgagcaactacaaccggcgctttacccccgaaattgctgaacggccgaaggtgagggatcaagccggccggatgaattattactggacgctgctgaaacctggtgataccatcatctttgaagctaacggaaacttgatcgctccaatgtatgcattcgccctgtcacggggattcggcagcggtataatcaccagtaatgcctcaatgcacgaatgcaataccaagtgccaaacgccccttggtgccatcaactcatctctgccctatcagaatatccatcctgtaaccatcggagagtgtcccaagtatgtcagatcagcaaaactgcggatggtcacaggtctccgaaataatccctcaatccagtctcgcggcctgttcggcgctatcgccggctttattgagggcggttggaccgggatgatcgacggctggtatggataccatcatcagaacgagcaggggagcggctacgcggctgaccagaagtcaacccagaatgctatcaatggtatcactaataaggtgaatacggtgattgaaaaaatgaacatacagttcaccgcagtgggtaaagagttcaataagctggagaagcggatggagaatctgaacaaaaaggtcgatgatggcttcttggacatctggacctataacgccgagcttcttgtgctgctcgagaacgagagaacactggacttccatgactctaacgtgaagaacctctacgagaaggtgaaatctcagttgaagaacaacgctaaggagatcggcaatggctgcttcgaattctaccacaagtgcgataacgaatgcatggaatctgttcgaaatggaacttacgattaccctaaatacagcgaggaaagtaagttaaacagagagaaagtagacggggttaagctcgaaagcatggggatctatcagatcctagccatctactcgactgtcgcgtcaagtttggtgctgctggtgtctcttggagccatatcgttttggatgtgctctaacggctccctgcagtgcagaatctgcata

SEQ ID NO: 473 - DNA, 1695 bp, Influenza A virus
  misc_feature (1)..(1695): Codon Optimized Sequence Encoding H1 Hemagglutinin
atgaaggccaacttgctagtgctgctgtgcgcgcttgcagctgcggatgcggatacgatatgcataggatatcacgccaataattcgacggataccgtggacacagtgctggaaaagaatgtaacggtcacacacagcgtgaacctgcttgaagattcacacaacggcaaactgtgcaggctcaaaggaatcgcaccattacagctggggaaatgcaacattgcggggtggctgctaggaaacccagagtgcgatcccctgctgcccgtgcggtcttggtcctacattgtagagactccgaactcggagaacggtatttgctaccctggagatttcattgactatgaagaactcagggagcaactgtcctcagtttcgagctttgaaaggttcgagatctttcctaaggagtccagctggcctaaccacaatacaaacggggtgaccgcggcctgttcacatgagggtaaatcttcattctaccgcaacctcctgtggttaaccgaaaaagaaggaagctatcctaagctgaagaattcttacgtgaataaaaagggtaaggaagttctggtgctgtggggcatccaccacccacctaatagtaaggaacagcagaacctataccagaacgaaaatgcgtacgtgagcgtggtaacttcaaactataatcggaggttcacacccgaaatcgcggagcggcccaaggtgcgggaccaggctgggcgcatgaattattactggacactgttgaaacctggagacactataatcttcgaggcgaacggaaacttaatcgctcccatgtacgcattcgccctgtcccgtggctttggcagcggtatcatcacatccaacgcctctatgcacgaatgcaatacgaagtgccaaacccctctcggagccattaatagctccctcccatatcagaacattcacccagtgaccataggagagtgtcctaagtacgttcggagcgcaaaactccgcatggtgacggggttgcgaaacaacccttccatccagtcgaggggccttttcggggcgatcgctggcttcatcgagggagggtggaccgggatgattgacggctggtacgggtatcaccaccagaacgagcagggtagcggctacgccgcagaccagaaatctacgcagaatgccattaatgggattacaaacaaggttaataccgtgatcgagaaaatgaacattcagttcacagccgtcggcaaagaatttaacaaattagagaagcggatggagaatctgaataaaaaagtggacgatggattcctggatatctggacgtataatgccgagttgctcgtccttctggaaaacgagagaaccctggactttcacgattcaaatgtaaagaacctttacgaaaaggtgaagtctcaactgaaaaacaacgccaaggagatagggaatggctgctttgaattctaccataaatgcgacaatgaatgtatggagtctgttaggaatggtacttacgactacccgaagtattccgaagagagcaagctgaatagggagaaggtggatggagtgaaactggaatctatggggatttatcagatcctagctatttattctacagtagccagctccctcgtccttctggtctccctgggcgcaatttcattttggatgtgcagcaacgggtccttacaatgccgcatctgtatt

SEQ ID NO: 474 - DNA, 1695 bp, Influenza A virus
  misc_feature (1)..(1695): Codon Optimized Sequence Encoding H1 Hemagglutinin
atgaaggctaacctgcttgtgttattgtgcgccctggcggcagcagacgcagataccatatgtatcgggtatcacgctaataatagcactgacaccgttgacaccgtcctggaaaaaaacgtgaccgtgactcattcagttaatcttttggaggacagccataatggcaagctttgtagactcaagggcatcgcacctttacagttgggtaagtgcaacatcgcaggatggctccttggcaaccctgaatgtgacccgctgctcccagtccggagttggtcatatatcgtagaaactcccaatagcgaaaacggcatttgctacccaggcgactttatagattacgaagagctccgggagcagctatcaagtgtctcgtcgtttgagcgttttgagatttttccgaaagaatccagttggccaaatcacaacacaaacggtgtaacagcggcttgttcacacgagggtaaaagttctttctacagaaatttattgtggcttacagagaaagaaggctcttacccaaagctgaagaattcttatgtgaacaagaagggtaaggaggtgttagtactgtggggaatacatcaccctcctaatagcaaggagcagcagaacttgtatcagaacgaaaacgcatatgtgtctgtggtgacatccaattataataggcgttttactcccgaaattgcagagcgacctaaagtgcgtgaccaggcaggtagaatgaattactactggaccctgttgaagcccggtgacaccatcattttcgaagcaaatggtaacctgatcgcaccaatgtacgcatttgcactgtcccgcggatttggctccggaatcattaccagtaatgcctctatgcatgaatgtaacaccaaatgccagacccccctgggcgccattaactccagcctgccttatcagaatatacatcctgtgacaataggtgagtgccccaagtacgtgagatctgcaaaactaagaatggtcaccggactcaggaacaatccctccatccagagtaggggtctgttcggagccatagcagggttcattgaaggtggatggacagggatgatcgatggatggtacggctaccaccaccagaatgagcagggctctggctacgccgctgaccagaaatctacacagaacgccattaatggcatcactaacaaagtgaataccgtcattgagaagatgaatattcagttcactgccgttggcaaggaatttaacaaactggagaagcggatggagaatctaaataagaaagtagacgacgggtttctcgatatttggacatataacgctgagcttctagtcctactcgagaacgagaggaccctcgacttccatgatagcaacgtgaagaacctatacgagaaggtcaagtctcaactgaagaacaacgctaaggagatcggaaatggatgtttcgagttttatcacaagtgtgataacgagtgtatggagtctgtaaggaacggtacctatgactacccaaaatacagcgaggaatcaaagctcaatcgtgagaaagtcgatggagttaagctggaatctatggggatttatcagatcttagctatctattcaaccgttgcttccagcttagtcctcctcgtgtcactgggggctataagtttttggatgtgcagtaatggcagtttgcagtgtaggatctgcatc

SEQ ID NO: 475 - DNA, 1695 bp, Influenza A virus
  misc_feature (1)..(1695): Codon Optimized Sequence Encoding H1 Hemagglutinin
atgaaggctaatttattggtgctgttgtgtgcactggctgccgcagacgccgacaccatctgcattggatatcatgccaacaattcaactgatacggtcgatacggtgcttgagaaaaatgtgacagttacacactctgtgaaccttctggaagactctcataacggcaaactttgtcggttgaagggtatcgccccactgcagcttggtaagtgcaacatcgccggttggctcctcggaaatccagagtgtgatccactgttacctgtgcgtagttggagttacatcgtggagactcctaatagtgaaaacggcatatgctatccaggcgatttcatcgattatgaagaactgcgtgagcagctgtccagcgtgtcctcattcgagcgctttgagatcttcccgaaagagtccagttggccaaaccacaataccaatggggtcactgccgcctgtagtcatgagggtaaaagctccttctatcggaatcttctctggctgaccgaaaaagaagggtcctaccccaaacttaagaattcgtacgtcaacaagaagggcaaagaagtacttgtgctgtggggtatccaccaccctcccaactctaaggagcagcagaatctgtaccagaatgagaacgcttacgtcagcgtggtgacctcaaattataaccgaaggttcactcccgagatagccgagcggcctaaggtcagagaccaagcgggtagaatgaattactactggacactactaaagcccggcgacaccatcatctttgaggcaaatggaaatctgatcgcccccatgtatgcatttgcactgagccgggggttcggatctggaatcataacttcaaacgccagtatgcatgaatgcaatacaaagtgtcagactcccttgggtgccatcaattccagcctgccttatcagaatatccaccctgtgacaattggagagtgcccaaaatacgttcgttcagctaaactgagaatggtcaccggcctccggaacaatcctagtatacagtcacgcggccttttcggcgccattgccggatttattgaaggaggctggacaggcatgatagacggatggtacggatatcaccaccagaacgaacaagggtctggctatgccgcagaccagaaatccacccagaacgctatcaatggtatcacgaataaagtcaataccgtcatcgagaagatgaatatccagtttacagctgtgggaaaagagttcaataagcttgaaaagaggatggagaacctgaataaaaaagttgatgacggatttctcgacatctggacgtataacgctgaactgcttgtgctgctcgaaaacgagaggacattggattttcacgactccaatgttaagaatctgtacgagaaggtgaaatctcagctcaagaataatgctaaggaaataggcaacggatgtttcgaattttatcataagtgcgacaatgaatgcatggaatcagtgcgcaacgggacctatgactaccccaagtacagcgaggagtccaagctgaatagagaaaaggtggacggcgtcaaactggaaagtatgggcatttaccaaattctcgccatctactctaccgttgccagcagtctcgtgctgttagtatcactcggtgccatctctttttggatgtgtagtaatggaagcctgcagtgccggatctgtatc

SEQ ID NO: 476 - DNA, 1695 bp, Influenza A virus
  misc_feature (1)..(1695): Codon Optimized Sequence Encoding H1 Hemagglutinin
atgaaggccaacctgctcgtgttgctgtgtgcactagctgccgccgacgcagacaccatctgtatcggctaccatgccaacaacagcaccgacacagtggatacggtgctcgagaagaacgtgactgtcacccatagtgtgaatctcctagaggattctcataatgggaagctatgccgactcaaggggattgcacctctgcaactgggtaagtgcaatatcgccggttggcttcttgggaaccccgaatgtgatcccctgctccccgtgcgatcttggtcatatatcgttgaaacacccaatagcgaaaatggcatatgctaccctggagatttcattgactatgaggaactccgagaacagctgtcaagcgtgtctagtttcgaacggtttgaaatattccctaaggagagttcctggcccaaccataacacaaacggagtgaccgcagcctgctctcatgaggggaagtcctcattttatcgcaatctcctgtggctcactgaaaaggagggaagttacccaaaattgaaaaactcatacgtgaataagaaaggcaaggaggtcctcgtgctgtgggggattcatcacccccctaactcaaaagaacagcagaacctgtatcagaacgaaaacgcctacgtgagtgtggtgacctctaactataaccggaggttcacgccagagattgctgaaagacctaaagtcagggaccaagccggcagaatgaattactattggaccctgttgaagcccggcgataccattatattcgaggcaaacggcaacctgattgcccccatgtacgcgttcgccctgagtcgaggcttcggcagtgggattattacctctaacgcctcgatgcatgagtgcaacacaaaatgtcaaactccacttggggccatcaactcgtctcttccttaccaaaatatccacccggttacaattggggaatgtcccaaatacgtgcggtccgcaaagcttcgcatggtcacgggcctgaggaacaacccctctatccagtctcgcggtctatttggcgctattgctggctttatcgagggggggtggacagggatgattgatggctggtacgggtaccatcaccaaaatgaacaggggtccggctatgctgctgaccaaaaatctactcaaaacgccattaatggaatcacaaataaagtgaatacggtcatagaaaagatgaacattcaatttacagccgtgggtaaggagttcaacaaactggagaagcgaatggagaacttaaacaaaaaggtagatgatggtttcctcgatatctggacatataatgctgagttgttggtgctcttggagaatgagcggaccttagatttccacgacagcaatgttaaaaacctctatgaaaaggtgaaaagtcaactgaagaacaatgcgaaagagatcggtaacgggtgcttcgagttctaccacaaatgcgacaacgagtgtatggagagtgtaaggaatggtacatatgattatcctaaatactctgaagagtcgaagctgaacagagagaaagtcgacggcgtaaagctggagagtatgggtatctaccaaatcttggccatctattctaccgtggcgtcatcactagttcttctggtgtccttgggggccatatcattctggatgtgttcaaacgggtccctccagtgccgcatctgcatc

SEQ ID NO: 477 - DNA, 1695 bp, Influenza A virus
  misc_feature (1)..(1695): Codon Optimized Sequence Encoding H1 Hemagglutinin
atgaaggcaaacctgttggtattgttgtgtgccctggcagctgcggatgcagacactatttgcatcggctatcatgcaaataattccacggacacagttgacaccgttctggagaaaaatgtgacggtcactcattctgtgaacctgctggaagactctcataacggaaagctgtgccggttgaagggaattgcaccactacaactgggaaaatgcaacatcgccggctggttgctaggtaaccctgagtgcgatccactccttccagtgagatcctggtcctacatcgtcgagaccccaaactcagagaacgggatctgttatccaggagatttcattgactatgaagagttacgtgaacagctctcttccgtgtcgtcattcgaacggtttgaaatcttccccaaagagtcatcctggccaaatcataacactaacggcgtgactgcagcttgttcccacgaagggaaatcatctttctacagaaatctgctgtggctcaccgaaaaagaggggagttatcccaagctgaaaaactcctacgttaataaaaagggaaaagaagtgcttgtcttatggggtatccatcaccccccaaattctaaagaacagcagaacctgtaccagaacgagaacgcgtatgtgtcagtggtgacctctaactataatcgcagatttacaccagagatcgcagagcgccctaaagtacgggaccaggccggtcggatgaactactattggaccctactgaaaccaggcgataccatcatcttcgaggctaatgggaacttaattgcccccatgtacgctttcgcacttagccgtggctttggcagcgggattatcacgtctaatgcttccatgcacgagtgtaatacgaagtgtcagacacctcttggtgccattaactcaagtcttccctatcagaacatccacccggtgaccatcggcgagtgtcccaagtacgttcgaagcgccaaactgcggatggtcacaggtctaaggaataacccctccatccagagccgcggcttgtttggtgcgattgccgggtttatcgagggagggtggactggcatgatagacggatggtacggataccaccaccaaaatgaacaaggctccggatacgccgccgaccaaaaatccacgcagaacgccataaacggaattacaaacaaggtaaacacagtcatagaaaaaatgaatattcagtttacagccgtcgggaaagaatttaacaagctggaaaagagaatggaaaacctgaataagaaggtcgacgatggttttctcgatatatggacttacaatgctgaacttctggtccttctggaaaacgaacgaaccttggatttccatgactctaatgtgaagaacttgtacgaaaaggtgaaatcacagttaaagaacaacgccaaagaaataggaaacgggtgcttcgaattttaccataaatgtgataacgagtgtatggagagcgttcgtaatggtacgtacgactatcctaaatatagtgaagagagcaaactcaaccgtgaaaaagtagacggcgtgaaactggaatccatggggatctaccaaatcctggccatctactcgacggtggcaagttctctcgtgcttcttgtaagcctgggtgctatctctttttggatgtgtagtaacggatccctgcagtgtcgaatttgcatt

SEQ ID NO: 478 - DNA, 1695 bp, Influenza A virus
  misc_feature (1)..(1695): Codon Optimized Sequence Encoding H1 Hemagglutinin
atgaaagcaaatcttttagttcttctgtgtgcgttggctgcagccgacgcagacactatctgcattggctaccatgctaataatagcactgacactgtagatacagtgttggaaaagaacgttacagtgactcactctgtcaatctgctggaggattcccataacggcaaattgtgccgtctaaagggcattgcgccactccagctgggaaagtgcaatatcgcaggctggctcctgggcaacccagaatgcgacccgctgctgcctgttcgctcatggtcatacatcgtcgaaacccctaacagtgagaacgggatttgctatcccggggatttcatcgattacgaagaattacgcgagcaactgagttccgtgtcgtcttttgagaggtttgagatcttcccgaaggaatcttcatggcccaaccataacaccaatggtgtgactgctgcctgttcacacgagggcaaaagctctttctaccgaaatctactgtggctcacagagaaagagggatcgtaccccaagctgaaaaattcctatgtgaacaagaaaggcaaagaggtgctggtgctttggggaattcatcacccacccaattctaaggagcagcagaatctgtatcagaacgaaaatgcctatgtttccgtggtaacatctaattataataggcgattcacacctgagattgcagagcggccgaaagtccgagaccaggcaggccgcatgaactattactggacgcttctcaaaccaggcgacaccatcatcttcgaggccaatgggaacttgatcgcaccaatgtacgcgtttgccttgagtcggggctttgggagcggtattatcacctcgaacgcctctatgcatgaatgtaatacgaagtgtcagacccctctgggggcaataaatagctcactgccctatcagaacatccaccccgtgaccatcggtgagtgtcccaaatacgtcaggtcagctaaactccgtatggtgaccggcctaaggaataatccgtccattcagtccagaggtctgttcggtgcaatcgccgggttcattgagggaggatggacgggtatgatcgacggctggtatggctatcaccaccagaacgaacagggtagtggctacgccgctgatcaaaagtccactcaaaatgctatcaacggaatcacgaacaaagtgaacacagtgatagagaagatgaacattcagttcaccgctgtgggtaaagagtttaataagctggagaaaaggatggaaaatctcaataagaaagttgacgatggattccttgacatttggacttacaatgccgagctgctggtgcttctggagaatgagaggaccttagactttcacgacagcaacgttaaaaatctctatgagaaagtgaaatcacagctgaagaataatgcaaaagagattgggaatgggtgcttcgagttttatcacaaatgcgataacgaatgtatggagtccgtgagaaatggaacgtacgactatcctaagtatagcgaggaaagcaaactcaacagggaaaaggtggacggtgttaaactcgaatccatggggatttatcagatattagcgatctattcgaccgtggcatcatctctcgttcttcttgtgtctttgggcgccatcagcttttggatgtgttcaaatggctctctgcagtgtcgcatctgtatt

SEQ ID NO: 479 - DNA, 1695 bp, Influenza A virus
  misc_feature (1)..(1695): Codon Optimized Sequence Encoding H1 Hemagglutinin
atgaaagccaatctactggtcctcctctgcgccttggctgccgcagatgctgacacgatctgtattggctaccatgcgaacaatagcacggatacagtggacaccgttctggagaaaaatgtcaccgtgacacatagcgtaaacctgctcgaagattcccacaacggtaagctctgtagactcaaaggtattgctcccctgcagttgggcaaatgtaatatagccggctggcttctcggcaatcccgaatgcgatcccctgttgcccgtgcggtcttggtcttatatcgtcgaaaccccaaattcagaaaacggaatttgttatcctggcgacttcatcgattacgaagagttgagggagcagctttcaagcgttagcagtttcgagagatttgagatatttccaaaggaaagttcctggcccaatcataacaccaacggcgtgaccgccgcttgctctcacgaaggcaaaagtagtttctatcgaaatctgctctggctgacggagaaggaaggaagttaccccaagctgaaaaactcctacgtcaacaagaagggcaaagaagtgctcgtactgtggggcatccatcaccctcccaattccaaagagcagcagaacctgtatcagaatgagaacgcttatgtatccgttgtgacttcaaactataatcgccggttcactcctgagatcgcagagcggcccaaagtgagagaccaggccgggaggatgaattattattggacactcctcaagccaggcgacacaattatttttgaggctaacgggaacttgatcgctcccatgtatgcgttcgccttgtcaagaggattcggatccgggattatcacctctaatgcttcgatgcacgaatgtaacacaaagtgtcaaactccactgggagccataaattcgtccttgccatatcagaatattcaccctgttacaattggcgagtgtcccaagtatgtccgctctgccaagttacggatggtgaccgggttgcgcaacaacccaagtatacagtcacgcggactgttcggagctatcgcgggattcattgagggaggctggacagggatgatcgatgggtggtacgggtatcatcaccagaacgaacagggatcgggatatgccgcggaccaaaagtcaacacaaaacgccatcaacggtattaccaataaggtcaacacagtgatcgaaaagatgaatatccagttcactgctgtgggcaaggagtttaataaactggagaagcgcatggagaacctgaacaagaaggttgacgacgggttcctggacatatggacgtacaatgccgagctgcttgtcctcctggagaatgagagaaccctggattttcacgattctaatgtgaagaatctgtatgaaaaagtgaagtcccaactcaaaaacaacgcaaaagagatcggcaacggatgctttgaattctatcataagtgcgataatgaatgtatggaaagtgtgaggaatgggacttacgattacccgaaatattccgaagagagcaaactgaatcgcgagaaagttgacggtgtaaagctggagtctatgggaatttaccaaattctggccatttattctaccgtggcatcaagcctggttctgctggtgtcccttggcgccatttcattctggatgtgttccaatggcagcctccagtgccggatatgtatc

SEQ ID NO: 480 - DNA, 1695 bp, Influenza A virus
  misc_feature (1)..(1695): Codon Optimized Sequence Encoding H1 Hemagglutinin
atgaaggctaaccttttggtccttttgtgcgcgcttgccgcggcggatgcagacaccatttgcataggataccacgccaataatagcacagacacagtggatacagtccttgagaaaaatgtcactgtaactcatagtgttaacttgctagaagactctcataatggtaaattatgtcggcttaagggaatcgcgccactccaattgggcaaatgcaacattgctggctggttgttaggtaatcccgagtgcgatcccctgctccctgtccggtcttggtcttacatcgttgaaacacccaacagtgagaatggcatctgttaccccggagacttcatcgactacgaagagctgcgagagcagctttcttccgtctcctcctttgaacgattcgaaatcttccccaaagagagctcatggccgaaccataacactaatggagttacagccgcctgctcccatgaggggaaaagcagtttttataggaacctgctgtggctgacagaaaaggagggcagctaccccaagctgaagaattcttacgtgaacaagaagggcaaagaagtattggtgctgtggggcattcatcatcctccgaactccaaggagcagcagaacctttaccagaacgagaacgcctacgtatcagttgttactagcaactataacagacgattcactcctgaaatcgccgagcggcctaaggttcgggatcaggctgggagaatgaactattactggaccctgttgaagcctggagacactattatctttgaggcaaatggaaacctgatcgcacctatgtatgctttcgcactcagccggggctttggctccgggatcatcactagtaatgctagcatgcatgagtgtaacacgaaatgtcagaccccactgggtgctataaacagttccctgccttatcagaacatccaccctgtgactattggagagtgtcccaagtacgtcaggagcgcaaagctccggatggtcacagggctgaggaataacccaagcattcagagccggggtctatttggggccatcgccggattcatcgagggaggctggactggcatgatcgatggctggtatggctatcatcaccaaaatgaacagggatccggctacgccgcagaccagaaatctacacagaatgcaatcaacggaatcacaaataaagtgaataccgtcatcgagaagatgaacatacaatttaccgctgtgggtaaagagtttaataaactagagaaacggatggaaaatcttaataaaaaggtggacgacgggttcctcgatatttggacatataatgccgagctattggtgctcctggaaaatgaaagaacgcttgattttcacgactctaacgtgaaaaatctgtacgaaaaggttaagagtcagctaaagaacaatgccaaagaaatcggaaatggttgcttcgagttctaccacaaatgtgataatgaatgcatggaatcagtccgaaacggtacctacgattatcctaaatattctgaagaatcaaagctaaaccgagagaaggtcgatggcgtcaagcttgagagcatgggtatctaccagatactggccatctatagtactgtggcatcttccctggtgcttctcgtgtccctgggggcgatctccttttggatgtgttcaaacggatccctgcagtgtcggatatgcatc

SEQ ID NO: 481 - DNA, 1695 bp, Influenza A virus
  misc_feature (1)..(1695): Codon Optimized Sequence Encoding H1 Hemagglutinin
atgaaggccaacctgctggttctgctttgcgctctcgccgccgccgatgctgatactatttgcataggttatcatgctaacaactccactgatactgttgatacagttctcgaaaaaaacgtaacggtcactcactctgtaaacctattggaagacagccacaatgggaagttgtgtaggcttaaaggcatcgctccactgcagctgggcaaatgtaacatcgcaggctggctcctgggcaacccggagtgtgatcctttactgcccgtccgctcctggtcttacattgttgagacacccaacagtgaaaacggtatctgttatcccggcgattttattgactacgaggagttgcgggaacaactgtcttctgtgagcagtttcgagcgcttcgagatttttcctaaggagtcttcttggcccaaccataacacaaacggggtgaccgctgcctgctcacacgagggcaagagtagcttctatagaaatcttctctggcttactgaaaaagagggatcttatccaaagttgaaaaacagttatgtgaacaagaagggaaaagaagtgctggtcctttgggggatccatcacccacccaactccaaggagcagcagaacctgtaccaaaacgagaacgcatatgttagcgtcgtgaccagcaactacaatcgcaggttcactcccgagatcgccgagaggcctaaagttcgcgaccaggctggacggatgaactactattggacactattaaagccaggcgataccataatatttgaagcaaatgggaacttaattgcaccgatgtacgccttcgcactgtcccgggggttcggaagcgggattattacctctaacgcctccatgcatgagtgcaacaccaagtgtcaaacacccctgggagctattaactctagcttgccctatcagaacatccacccagtcactatcggcgagtgtcctaagtacgttagatcagccaagctgcgcatggttacggggcttcggaacaacccctcaatccaatctcgggggcttttcggtgcaatcgccggctttatagaaggcggttggaccggaatgattgatggctggtatggctaccaccaccaaaacgaacagggaagcgggtatgctgcagaccagaagagcacacagaatgctatcaatgggatcaccaacaaagtaaacacggtgattgagaaaatgaatattcagttcacagcggtgggcaaggagttcaacaaactggagaagcgtatggaaaatctgaataaaaaagttgacgacggtttcctagacatctggacatataacgccgagttgttggtgctcctcgaaaacgagcgcacactcgacttccacgattctaacgttaagaatctttacgaaaaagttaaatcgcagctgaaaaacaacgcgaaggagatcggtaacggctgtttcgagttttatcataagtgtgataatgaatgcatggaatccgtgcggaacggtacctacgattatcctaaatattcagaggagagtaaactcaatcgcgagaaggtcgatggagtcaagcttgagagtatgggaatttatcagattctggcaatctatagcaccgtcgcatccagtctcgtcctccttgtttcactgggagctatttcattctggatgtgctctaacgggtcgctgcagtgcagaatctgcatt

SEQ ID NO: 482 - DNA, 1695 bp, Influenza A virus
  misc_feature (1)..(1695): Codon Optimized Sequence Encoding H1 Hemagglutinin
atgaaggcaaatcttctggtacttctctgcgccctcgctgcagccgacgcagataccatttgtatcggctaccacgcgaataactcaacggataccgtggacaccgtgttggagaagaacgttaccgtcacacatagtgtgaatctgcttgaagattcacataacggaaaactttgtaggctcaaaggcatcgcgccactgcagctggggaaatgcaatattgcaggttggttactgggtaacccagaatgcgatcctctgttacctgtgcgtagttggagctatatcgttgagaccccaaattcggagaatgggatctgctatccaggggacttcattgactatgaagagctgcgagaacagctcagcagcgtatctagcttcgagagatttgaaattttcccgaaggaatccagctggccaaaccacaataccaatggcgttacggccgcctgtagccacgaaggtaagtctagcttctacagaaacctgctgtggctgacagaaaaggaggggtcttacccgaagttgaagaatagctacgtcaataagaaaggaaaagaggtccttgtcctctggggcatccaccaccctccaaactcgaaggaacagcagaacctttatcagaacgagaacgcttatgtctccgtggtgacatccaattataacaggcgtttcacaccagagatagccgaaaggcccaaggtccgcgaccaagctggtaggatgaattactattggacactcctcaaaccaggagacacaattatttttgaagcaaatgggaacctgattgcccccatgtatgcctttgcgctaagccgcggtttcggaagcggcattatcacgagtaatgcatcaatgcacgagtgtaacaccaaatgtcaaacccccttgggcgcaattaactcttccctcccttaccagaacatccaccccgtcaccatcggtgagtgccctaaatacgtacggtctgctaagttgcggatggtcaccggcctgcgaaataaccctagcattcagtccagagggttatttggcgcgatcgcaggattcatcgagggagggtggaccggcatgatagacgggtggtatggataccatcatcagaacgagcaaggcagcggctacgctgctgaccaaaagagcacgcagaacgcgatcaatggaatcacgaataaggttaacacggtcatcgaaaagatgaacatacagttcacagctgtgggcaaggagttcaacaagcttgaaaaaagaatggagaacttgaacaaaaaagtagacgacggctttctcgatatttggacttacaacgccgaattgctagtcttgttggagaatgaacgcaccttggacttccacgactccaacgtcaagaatttatacgaaaaggtcaaaagccagcttaagaataacgccaaggagatcggcaatggctgtttcgaattttaccataaatgcgataatgaatgtatggaaagtgttaggaacggcacatacgactaccctaaatactccgaagagagcaaactcaatcgggagaaggttgatggagtgaagttagagagcatgggaatttaccaaatactcgccatctatagcaccgttgcctcaagcctggtcctcctagtgtccctgggcgccattagtttctggatgtgttccaatgggtctttgcaatgtcgcatctgtata

SEQ ID NO: 483 - DNA, 1695 bp, Influenza A virus
  misc_feature (1)..(1695): Codon Optimized Sequence Encoding H1 Hemagglutinin
atgaaagctaacctgctggtcctcctatgtgctctcgctgccgcagatgccgataccatatgcattggatatcacgcgaacaacagcaccgatacggtggatacagtgctggaaaaaaacgtgactgtgacacattctgtcaatctcctggaagactcccacaatggcaagctgtgtcgtttgaaggggatcgcccccctgcagctcggaaagtgcaacatagcagggtggctgctcgggaatccagagtgcgatccgctgctcccggtacggagctggtcttacattgttgagacacctaacagcgagaatggcatttgttatcctggagacttcatcgactacgaggaactccgggaacagcttagctccgtaagcagcttcgaaagatttgagattttccctaaggagtcatcctggcccaaccataatacaaacggagtgaccgctgcctgttctcatgaagggaaaagttccttttacagaaatctcctgtggctgactgagaaagaaggaagctatcctaagctgaagaattcttacgttaataagaaaggaaaagaagtgctggtcctctgggggatacatcaccccccaaatagcaaggagcaacagaatttatatcagaatgagaacgcatacgtctcggttgtgacttcgaactacaacaggcggtttacacccgagatcgcagagcgccccaaggttagagaccaggctgggaggatgaattactattggacgcttctcaagccaggggataccattatttttgaggctaatggcaatctgattgcccctatgtacgccttcgctctgtcaaggggatttggaagcggcatcatcacctccaacgcttccatgcatgagtgcaacaccaagtgtcagacacccttaggcgcaatcaacagcagtctgccctatcaaaacattcatcccgtgacaatcggcgagtgtccgaaatacgttcgatccgcgaagttaaggatggttacgggcctacgtaataacccttcaatccagtctcgtggcctcttcggtgctatcgctggtttcatcgaaggaggctggacaggaatgatcgacggatggtatggatatcaccatcagaatgagcagggcagtgggtatgccgcagaccagaaatccacccagaatgccataaatggaatcaccaacaaggtgaacacagttatcgaaaagatgaacatccagttcaccgccgtgggaaaggagtttaacaaacttgagaagagaatggagaatcttaataaaaaggtagatgatgggttccttgatatctggacatataacgccgagcttctagtgctcctggagaacgagaggactctggactttcacgactccaacgtcaaaaacctatacgaaaaggtcaagagtcaactgaaaaataacgcaaaagagataggtaacggatgttttgagttctaccacaaatgcgataacgagtgcatggaatccgtgaggaatggtacctatgactatccaaaatattctgaggagtccaagctcaaccgagaaaaggtggacggcgtaaagctcgaaagcatggggatttatcagatacttgcaatttattccactgtggcttcttccctggtgcttttggtcagcttaggggctatcagcttctggatgtgttccaacggctcccttcagtgtagaatttgcatc

SEQ ID NO: 484 - DNA, 1695 bp, Influenza A virus
  misc_feature (1)..(1695): Codon Optimized Sequence Encoding H1 Hemagglutinin
atgaaggcaaacttgttggtgctactctgcgcattagcagctgctgacgcagatacaatttgtatcgggtaccacgccaataactctacagatacagtagataccgtccttgaaaaaaatgtcaccgtgacccatagtgtaaacctcctagaagatagccataacggcaaactgtgtcggcttaagggcatcgcgcctctacagctgggcaagtgtaacattgctggctggctccttggcaatcctgagtgcgaccccttgctgccagtgaggtcctggagctacatcgtggaaactcccaattctgagaatggaatatgttatccgggggatttcatcgactacgaagagctgcgcgaacaactctcatcagtcagctcctttgaaagattcgaaatcttccccaaggaatctagctggccaaaccataacactaatggagtaacagctgcatgttcccacgagggcaagagctctttttacaggaacctcctatggctgacggagaaagaagggtcctaccccaagctgaaaaatagctacgttaacaagaaaggaaaagaggtgttggttctgtggggaattcatcatcctcccaacagtaaggagcagcagaatctctatcaaaatgaaaacgcttacgtcagtgtggtgacgtctaattacaacaggagatttacaccagagattgccgagcggccgaaagtgagagatcaggcaggcaggatgaattattactggacacttctgaaacctggagacacaatcattttcgaagctaatggaaacctcatcgcaccgatgtacgcattcgccttgtcccggggattcggctccggcatcatcacctccaacgcttcaatgcatgaatgtaatactaaatgccagacgccgcttggcgctattaactcatccttgccttatcagaatattcatcccgttaccattggagagtgtcccaaatacgtgcgttcagccaaactgcggatggtcactggcctgcgaaataacccttcaattcaatctcgcggactgttcggagctatcgccggcttcatagaagggggctggaccggcatgattgacggatggtacggttaccatcaccaaaacgagcagggttccggctatgccgccgaccagaaatcaacccagaacgccataaatggtattaccaacaaggttaatacggtcatcgagaaaatgaacatccagttcacagcagtgggaaaagaatttaataagctcgagaaaagaatggaaaacctgaacaaaaaagtggacgatggtttcctcgacatatggacctataatgctgagctactcgtccttctggaaaatgagcgaacgcttgacttccacgattcgaatgtgaaaaacctatacgaaaaagtgaagtcccagctcaagaacaatgcgaaggagatcgggaacggctgctttgagttttaccacaaatgtgataacgaatgcatggagtctgtgcgaaatgggacatacgactatcctaagtattcagaagagtcaaaactcaaccgggaaaaggttgacggagttaagcttgagtcaatgggaatttaccaaatcctggcaatctactctactgttgcctcttcactcgtcctcttagtttcactaggggctatcagtttctggatgtgttctaatggtagcctgcagtgtcgaatttgtata

SEQ ID NO: 485 - DNA, 1695 bp, Influenza A virus
  misc_feature (1)..(1695): Codon Optimized Sequence Encoding H1 Hemagglutinin
atgaaagctaatctcttagttctgctctgcgccttagcggctgcagatgccgacaccatatgcattggctaccacgctaataactccaccgatacagtggacaccgtgctggaaaagaacgtcactgtgacccactcagtgaacctgttggaggattcacacaacggcaagttatgcagactcaagggaattgcaccactgcagctgggtaagtgtaatatcgctggctggcttctcggaaatcccgagtgcgaccctctgttacctgtcaggagctggagttatatcgtggaaactcctaatagtgaaaatggaatatgctatcccggcgacttcatcgactacgaggagctaagggaacagctgtcaagcgtctcctccttcgaaagattcgagatcttcccgaaggagagttcgtggccaaaccataacactaacggggtcaccgcggcctgttctcacgaggggaagtcatccttctaccgaaaccttctgtggctgacggagaaagaaggcagctatcccaaactgaagaatagttacgtgaataagaagggaaaggaggtactggtcctctggggcatccatcatccccccaacagtaaggagcagcagaatctttaccagaacgagaacgcttatgtgagcgtcgtaacctcaaactacaaccgcaggttcactcctgaaattgccgaacggccgaaagtgagggaccaagccggccgcatgaactactattggacgcttctcaagcccggtgatactattattttcgaggcaaacggcaacttaatcgctcctatgtacgcatttgcactgagtcggggttttggttcgggcatcatcacctcaaatgcttccatgcacgaatgcaatacaaaatgccagaccccacttggagccatcaactcctcactgccttatcagaatatccacccagtcactatcggggaatgcccgaaatatgtcagaagcgctaagcttcggatggtgaccggtctgcgcaataatccgtctatacaatccaggggactgtttggcgcgatagccggatttattgaggggggatggactggcatgatcgatgggtggtacgggtaccatcaccagaatgaacagggttccggctacgccgcagatcaaaagtccacccagaacgctattaacggaatcaccaacaaggtcaatactgtcattgagaaaatgaatatccagttcactgccgtgggcaaggagttcaataagctagagaagcgtatggaaaaccttaacaagaaggtggacgatggatttttggatatttggacctataatgctgagttgttggtcctcctggagaatgaaagaactctggacttccatgatagcaatgtgaaaaacctctacgaaaaagtcaaatcacagcttaagaacaacgccaaagaaattgggaatggatgctttgagttttaccataaatgcgacaacgagtgtatggagtctgtcagaaacggcacatacgattaccccaagtattccgaagaatcaaaactgaatcgggaaaaggttgatggagtgaaattagaaagcatgggaatctatcaaattcttgcaatttatagcaccgttgctagctcactggtcctgctcgttagtttgggcgccattagcttctggatgtgtagcaatgggtctctccaatgcagaatttgcatt

SEQ ID NO: 486 - DNA, 1695 bp, Influenza A virus
  misc_feature (1)..(1695): Codon Optimized Sequence Encoding H1 Hemagglutinin
atgaaagcgaatctgctggtcctgctgtgcgccctggcggctgctgacgcggatactatttgcatcggctatcacgctaataactcgacagacaccgtggatacagtcttggagaaaaatgtgactgtaacccactcggttaaccttctcgaggactcgcataacgggaaactgtgtaggctgaagggaatcgcaccactccagctgggcaagtgcaatatagctggctggctgctcgggaatcctgagtgcgaccctctcctgcccgtccggtcctggagctatatagtggaaacacctaacagcgagaatggtatctgctatccgggggattttatcgactatgaggaactacgagaacagctctcctccgttagcagcttcgagcgatttgaaatctttcctaaggagagcagttggcctaaccacaacactaatggggtgacagccgcctgtagccatgagggaaagtcttctttttatagaaacttgctgtggttgactgagaaagaggggagctacccgaaactaaagaactcctacgtgaacaagaaaggcaaagaggttttggttctgtggggcatccaccatcctcccaatagcaaggaacagcagaatctctatcagaacgaaaacgcctacgtgtcagtggtgaccagtaattataatcgacgctttacccccgaaattgcagagcggccgaaagtccgcgaccaggccggacgcatgaattactattggaccctgctaaagcccggggacactatcatatttgaagccaacgggaacctgattgcacccatgtatgcgtttgctctgtcacgcgggtttggtagcgggattatcacttccaacgcttcaatgcatgaatgtaacactaagtgtcagaccccactgggcgccattaacagctcgctgccataccagaatatacacccagttactattggtgaatgtcctaagtatgtacggtccgccaagctgcggatggttactggcctcaggaacaatccttcaattcagtctagggggctgttcggagccatagctggctttattgagggaggctggacaggcatgattgacggctggtacggctaccaccatcagaacgagcaaggctccggctacgccgcggaccagaagtcaactcaaaatgcgataaacggaatcaccaacaaggtgaacaccgtcatagaaaaaatgaatatacaattcacagccgtgggaaaggagttcaataagctcgagaagcgtatggagaatctcaataaaaaagtggatgatgggttcctcgatatctggacctataacgctgaactcttagtcctcctcgaaaacgagcgaacgctcgacttccatgattctaatgtaaaaaatctttacgaaaaggttaagtcacagctgaagaacaacgccaaggagataggaaacggctgtttcgagttttatcataagtgtgacaacgagtgtatggaatctgtccgcaatggcacttatgattaccccaagtactccgaggaaagtaaacttaatagagaaaaagttgatggcgttaagctggagtcaatggggatttatcagatcctagctatatattctactgtggcttctagtctcgttttgctggtgagcctgggagccataagcttttggatgtgtagcaatgggtccctccagtgtcgaatctgtatc

SEQ ID NO: 487 - DNA, 1695 bp, Influenza A virus
  misc_feature (1)..(1695): Codon Optimized Sequence Encoding H1 Hemagglutinin
atgaaagccaacttgctggtgttgctctgcgcccttgccgccgccgacgcagataccatttgtattggctaccatgccaataattctacggacactgtggataccgtcttggagaaaaatgtaactgtaactcactccgttaatcttctcgaagattcacacaatggcaagctgtgccgccttaaaggcattgcccccttgcagctgggcaagtgtaatattgctggatggctcctcggcaatcctgagtgtgaccccctcctgcccgttaggtcgtggagctacattgtggagaccccaaattcggaaaatgggatatgttacccaggcgactttatcgactatgaggaactacgtgagcagctgagttctgtttccagttttgaaagatttgagatctttccaaaggagagctcttggccgaaccataacaccaatggggtcaccgccgcttgcagtcatgaaggaaaatcaagcttctaccgaaacttgctgtggctcacggaaaaggagggctcctaccccaagttgaagaactcctatgtgaacaaaaagggcaaagaggttctcgtgctctggggaattcaccaccctcccaacagcaaggagcagcagaacttgtatcagaacgaaaatgcttacgttagcgtggtgacttccaattataatcgacgctttacaccggagattgctgaacgcccgaaagttcgggatcaagccggccggatgaactattattggaccctcctgaaacccggtgatactattatttttgaggcaaacggaaacctgattgctcccatgtacgccttcgccctgtcccgggggtttggcagcggaattataactagcaacgctagcatgcacgagtgtaatactaagtgtcagacccctctgggggcaataaactccagcttaccttatcagaacatccaccctgttaccataggcgagtgcccgaagtacgttaggtcagctaagctaagaatggtcactggtttgaggaataaccccagcattcagagtagggggctgtttggggcaattgcaggttttatcgagggcggttggactggtatgatcgacggctggtatggatatcatcatcagaatgagcaggggtctgggtatgctgcggaccagaagtccacgcaaaatgccataaacggaatcacgaataaggttaataccgtcatcgaaaaaatgaacattcagtttactgcggtgggtaaggaattcaataaactcgaaaagagaatggagaacttaaataagaaagtcgacgacggatttttggatatctggacctataacgccgaactcctcgttctgttggagaacgagcgcaccctcgacttccacgatagtaacgtgaaaaatctgtatgagaaggtgaagtcccagctcaagaacaatgccaaggaaatcggaaacggatgttttgagttctaccacaagtgcgacaatgaatgcatggagagtgtgcgcaatgggacgtacgactaccctaaatatagtgaagagtctaagctcaaccgggagaaggtggacggagtgaagctggagagtatgggaatttaccagatactggctatctacagtacagttgccagctccctcgttcttctggtgtctctgggggccatctctttctggatgtgttccaatggcagcctccaatgccggatctgcatt

SEQ ID NO: 488 - DNA, 1695 bp, Influenza A virus
  misc_feature (1)..(1695): Codon Optimized Sequence Encoding H1 Hemagglutinin
atgaaagcaaatcttctggtgttactatgcgcattagctgccgctgacgccgacaccatttgcattggctatcacgccaataatagcactgacactgtcgacacagttcttgaaaagaacgtgactgttacccactccgtgaatctactcgaggattctcataacggaaagctctgtcgccttaagggtattgcccctctccagcttggaaaatgcaacattgctggctggctgcttggaaaccctgaatgtgacccactcctgcccgtccggagctggagttacatagtggagactccaaatagcgagaacggtatatgttacccaggtgatttcattgactatgaggagttgagagagcagttgagctccgtttcgtcttttgaaaggttcgagatcttcccaaaagagtcaagctggcctaaccataacaccaatggtgttacggccgcatgtagccatgagggcaagtcgtccttttatcgaaatctcctatggctcacagagaaggaaggatcttacccaaagctcaagaactcgtacgtaaacaagaaggggaaggaagtccttgttctgtggggtatacatcacccaccaaattccaaggaacagcagaatttatatcagaacgaaaacgcatatgtttctgtcgttacatccaactataaccggagattcaccccagagatcgccgaaagaccgaaggtgcgggaccaggcagggcgaatgaactattactggacattgctcaagcccggagacaccataattttcgaggctaatggcaacctcattgccccgatgtacgcattcgctctttctcggggatttggcagtgggattatcacctcgaacgcctccatgcatgaatgtaatactaaatgtcaaacaccactgggagccattaacagtagcctgccctatcaaaatatccacccggtcactattggggagtgcccaaagtatgtgcggtctgcaaagttgagaatggttaccgggctgcgcaacaatccaagtattcagagtagggggctatttggtgcaatagcaggctttatcgaagggggctggactggaatgatagatggctggtatggatatcaccaccagaacgagcagggtagcggctacgccgccgatcagaagagcactcagaatgctatcaacggaatcacaaataaagttaataccgtaatagaaaagatgaatatccagttcacagctgtgggtaaagagttcaacaagctggaaaaacggatggaaaacctgaataaaaaggtggatgatggtttcctcgatatatggacttataacgctgagcttctggttctgctggaaaatgaacgcacactggacttccacgatagtaatgtaaaaaatctgtatgaaaaggttaaatcacaactgaaaaataatgctaaggaaattgggaacgggtgtttcgaattctatcacaagtgcgataatgagtgtatggagtcagttcggaacgggacctacgattatcctaagtattcagaagagtctaaactgaaccgcgaaaaagtggatggagtcaaactggagtcgatgggcatctatcagatcctcgccatttatagcaccgtggcatcgtccctggtgcttttggttagcctgggcgccattagtttctggatgtgtagtaacgggtctctgcagtgtaggatttgtatt

SEQ ID NO: 489 - DNA, 1695 bp, Influenza A virus
  misc_feature (1)..(1695): Codon Optimized Sequence Encoding H1 Hemagglutinin
atgaaggcaaatctgctcgtgttactctgcgctttggccgccgctgacgccgacactatttgcatcggttaccacgccaacaacagcaccgatacagtggacacggtattggaaaaaaacgtaactgtgacacattcagtaaacctgctcgaggacagccacaacggtaagctgtgccggttgaaaggtatcgcaccactgcagcttggaaaatgtaatatcgccgggtggctgctgggcaatcctgagtgtgatcctctgctccctgtacggagttggtcgtatattgtggaaacccctaacagcgaaaacgggatttgttatcctggcgactttatcgactatgaggagctccgggagcagctgtccagcgtaagttcattcgagaggttcgagattttccccaaagagagttcctggcctaaccacaacacaaacggtgtgacagctgcctgcagccacgaggggaagtcctcattctataggaatttgctctggctgaccgaaaaggaaggttcgtacccgaagcttaaaaattcttacgttaacaaaaaggggaaggaggtactcgttctgtgggggatccatcatcccccaaattctaaggaacagcagaacctataccagaatgaaaacgcatatgtcagcgtggtcacatctaactacaacagacgcttcacacccgaaatcgctgagcgccccaaggtacgagatcaggctggcaggatgaactactattggactttactgaagccgggcgatacaataattttcgaggctaacggaaatctgatcgccccaatgtatgcctttgctctttcccgcggctttggttcagggattattacttctaacgcttcgatgcacgagtgtaataccaaatgccagaccccgctgggcgccattaatagctcattgccttatcagaatatccatcccgttaccattggcgaatgtcccaagtatgtgaggagcgcaaaacttcggatggtaacaggtctaaggaataaccctagcattcagtcacgggggctgtttggggcaatagcaggctttattgagggcggatggacaggcatgatcgatggctggtatggttaccaccatcagaacgagcagggctctggatatgcagccgaccagaagagtacacaaaatgcaatcaatggcattactaacaaagtgaacacggtcattgaaaaaatgaatatccagttcacagccgtgggaaaggagtttaacaagctggaaaaacggatggaaaatctaaataagaaagtcgacgacggttttttggatatctggacctacaacgctgaactactggttcttctggagaacgaaagaaccctggactttcacgactctaatgtgaagaatctgtacgaaaaagtgaagtctcagttgaagaacaacgctaaagagattgggaatggctgtttcgaattctaccacaaatgcgataatgagtgcatggagtctgtcaggaatggtacttacgactatcccaagtattctgaggagagtaagctcaacagggaaaaagtcgacggagtcaaactggagtcgatgggcatataccagattctagccatctactccaccgtggccagtagtttagtcttgctcgtaagccttggcgctatctccttctggatgtgctccaatggatccctgcagtgtagaatctgtatc

SEQ ID NO: 490 - DNA, 1695 bp, Influenza A virus
  misc_feature (1)..(1695): Codon Optimized Sequence Encoding H1 Hemagglutinin
atgaaggcgaatctactggttttattgtgcgccctcgctgctgccgacgccgataccatctgcatcggataccatgccaataactccacagataccgtggacactgtgctggaaaagaatgttacagtgacacattcagtgaacctgctggaagatagtcataatggcaaactgtgtagactaaagggcatcgcccccctgcaacttggtaagtgtaacatcgctggttggcttctggggaaccccgaatgcgatccactgctgcctgtccgcagttggtcctatattgtcgaaacccccaactctgaaaacgggatttgttatccaggagacttcattgactatgaagaattgcgggaacagctttcaagtgtgagctctttcgaacggtttgaaatctttccgaaggagtcctcgtggccaaatcataacactaatggcgtgacagcggcatgtagtcacgaaggaaaatcttccttttatagaaacctcctgtggctgacagagaaggaaggcagttatcccaaactgaagaacagttacgtcaataaaaaggggaaagaagtactggtactttggggaatccaccatccccccaacagcaaggagcagcagaatctttatcaaaatgagaacgcctacgtcagcgtggtgacctcgaattacaacaggcggttcacaccagaaatcgcggaaaggccgaaggtgcgggatcaggccggcaggatgaactactattggactctcctaaaaccaggcgacactattatatttgaagccaacggcaaccttatcgctccaatgtacgccttcgctttgagccgtgggtttggctccggaattataacatcaaatgcaagtatgcacgagtgcaacacaaagtgccagacaccactcggagcaatcaacagctccttgccataccaaaacattcatcctgttaccatcggcgaatgcccgaagtatgtgaggagcgcaaaactgaggatggtgacgggcttgcggaacaacccttctatccagtcccggggcctgtttggagcgatcgcaggattcattgaagggggatggacggggatgatcgatggatggtacggatatcatcaccaaaatgaacaagggtcaggttatgctgctgatcaaaagtcaacacagaatgcaatcaacggcataaccaataaagttaacacagtgattgaaaaaatgaatattcagtttaccgccgtgggaaaagagttcaataaactggagaagaggatggagaatttgaacaagaaggtagatgacggctttctcgacatttggacttataatgcagagctattagtgctcctcgagaatgagagaactcttgactttcacgacagtaacgtaaaaaacctctatgaaaaggtcaaatcacagcttaagaataatgcaaaagagatcggaaacggatgcttcgaattttaccacaaatgcgacaacgaatgtatggaatccgtgaggaacggtacctacgattaccccaagtacagcgaggaaagcaagctgaatcgagaaaaagttgacggtgtgaagctggagtccatgggcatctaccagattcttgctatctattctacagtagcttcctcccttgtacttctggtgtccctgggtgccatttcattctggatgtgcagcaacggttccttgcagtgtcggatctgcata

SEQ ID NO: 491 - DNA, 1695 bp, Influenza A virus
  misc_feature (1)..(1695): Codon Optimized Sequence Encoding H1 Hemagglutinin
atgaaagctaatcttctcgtgttgctgtgcgccttagcggccgcagacgcggacacaatctgtattgggtaccatgccaataattccactgacaccgtagacactgtactggaaaagaatgtgacggtaacccactccgttaatctgctggaggactctcacaacggcaaactctgtcggctgaaaggtattgcaccacttcagctggggaagtgtaacattgccggatggctactaggcaaccctgaatgtgaccccctgctgccagtgcgaagctggagttacattgtggaaactcccaatagtgaaaacggtatctgctaccctggcgatttcattgattatgaagagctgagggaacagctttctagtgtgtcgtccttcgagaggtttgagatcttccccaaggagagctcatggccaaaccacaatacaaacggggtcactgcggcatgtagccatgagggcaagtcatccttctatcgaaacctcctgtggctgaccgaaaaggaaggtagctaccccaaacttaaaaacagttatgtgaacaaaaagggcaaggaagtcttagtgctttggggcatccaccaccccccaaatagcaaagagcaacagaatttgtaccagaacgaaaatgcttatgtgtctgtagtaacctctaactataacaggcgtttcactcccgagattgccgagcgaccgaaagttagagaccaggccggacgcatgaattactactggaccctgttgaaacctggagatacgataatctttgaggccaacggaaacctgatagctcctatgtatgcgttcgcactcagtcgcgggttcgggtccgggataatcaccagtaacgcgtccatgcacgagtgtaatacgaagtgccagaccccactaggagcgattaactcgtctctgccatatcagaatatccatcctgtgacaatcggagagtgtcctaaatacgtccgctcagccaaactgcgaatggtgacgggccttcgcaacaatcccagtatccagtctcggggactctttggagccatcgccggttttatcgaaggcggatggactgggatgatcgatggctggtacggctaccaccaccaaaatgagcaaggctccgggtacgctgccgaccagaagtcaactcagaatgcaattaacgggatcaccaacaaggttaacaccgtaatcgaaaagatgaacatccagttcacggccgtggggaaggagtttaataaacttgagaaacggatggagaacctcaacaaaaaggtggacgacggctttctggacatctggacctataatgctgagcttttggtgctgctggaaaacgagcgcacactggatttccacgatagtaatgtgaagaacctgtacgaaaaggttaagtcccaactcaaaaataacgcgaaagaaatcggcaatgggtgctttgaattttatcacaagtgtgacaacgaatgcatggaatctgtgcggaatgggacctacgattacccaaaatatagcgaagaatccaagctgaacagagagaaggtggacggcgtgaaactcgaaagtatgggtatctaccaaatcctagccatctactctaccgttgccagtagtctagtgttgctggtgtcgttaggtgccatctctttttggatgtgtagcaatggctctctgcaatgtcggatctgtatc

SEQ ID NO: 492 - DNA, 1695 bp, Influenza A virus
  misc_feature (1)..(1695): Codon Optimized Sequence Encoding H1 Hemagglutinin
atgaaggccaacctgcttgtgctgctttgcgcactagccgctgcagacgccgacacaatttgtattggataccatgctaataactcgaccgacacagttgacacagtccttgagaagaacgtgacagttactcactccgtgaacctgctcgaggactcgcataatggcaaactctgccgtctgaagggtatcgcccccctccaactggggaaatgcaatatagccggctggctgctgggaaatccagagtgcgatccactgttgcctgtgcgcagttggagttatatcgtggagacacccaactcagagaacggtatctgctaccctggggacttcatagattatgaagagctgcgcgagcagctatcttccgttagctctttcgaacgctttgaaatctttcctaaagaaagcagctggccaaatcataacacaaacggagtgacagctgcctgcagtcacgagggtaaaagttctttttatagaaatctcctgtggttgacggagaaagagggcagctatccaaagctcaagaatagctacgtcaataaaaaaggtaaggaggtgctagtcttatggggaatccatcacccacccaattccaaggaacagcagaacctctatcagaacgagaacgcctatgtgtccgtagtgactagcaactataatcgtagattcacacctgagattgcagagagacccaaggttagagaccaagccggccgcatgaattattactggacactgcttaaacccggggatactatcatcttcgaagcgaatggaaacctgatcgctccaatgtatgcttttgctctgtccaggggttttggctcggggattatcacaagcaacgcatctatgcacgagtgtaataccaagtgtcagaccccccttggcgctatcaactctagtctaccgtaccagaacatccaccctgttaccattggtgaatgcccgaaatacgtgcggagtgccaagctgagaatggtgaccggcctgaggaacaatccttccatccagtcccggggacttttcggagctatcgctggcttcattgaaggtgggtggaccggcatgatcgacgggtggtatggatatcaccatcagaacgagcaaggaagcgggtatgctgcagaccagaagtccacacagaacgcaataaacggcatcactaacaaagtgaacaccgtgattgaaaaaatgaatatacagtttaccgccgtagggaaggaatttaataaactggaaaagcgcatggaaaatttgaacaaaaaagtcgacgatggttttttagacatttggacctataatgcggaactgctagtactgctcgagaacgaacggaccctcgactttcacgattcaaacgtcaaaaatctatacgagaaggtgaagtcgcagctgaagaataatgccaaagaaatcggcaacggatgtttcgaattctaccacaaatgcgacaatgaatgtatggaatctgttagaaacggcacgtatgattaccccaagtacagcgaagaatctaaactcaaccgggagaaagtcgacggagttaagcttgagtccatgggaatctatcagatcttggcgatctattccaccgtggcaagttccctcgtattgctggtgtcccttggagcaatttcattctggatgtgcagtaacggcagccttcaatgccgcatctgtata

SEQ ID NO: 493 - DNA, 1695 bp, Influenza A virus
  misc_feature (1)..(1695): Codon Optimized Sequence Encoding H1 Hemagglutinin
atgaaggcaaaccttcttgtcctgctgtgcgcactcgccgcagccgacgccgacacaatctgcattgggtatcacgctaataattcaactgacactgtggataccgtactggaaaagaatgttactgtgactcatagtgtaaatctgctcgaggacagtcacaatggaaaactttgccggttaaagggcatcgcacccctgcagctgggtaagtgcaacatcgcgggatggctgctgggcaaccccgagtgtgatcccctgcttccagtgcggtcttggtcttacattgtcgaaacacccaactctgaaaacggaatttgttaccctggcgacttcatcgactacgaagagcttagagagcagctatcgagcgtgagttcttttgaaagatttgagatcttcccaaaggaaagctcttggcccaaccataatactaatggcgtcacagccgcctgctcacatgaagggaagtcttctttctacaggaatctgttgtggttgacggagaaggagggaagttatccaaagcttaaaaattcctacgtgaacaagaagggtaaagaggtcctggtgctctggggcatccaccatcctccgaactccaaagaacagcagaatctgtatcagaacgaaaatgcatatgtcagtgtggtgacaagtaattataaccgccgctttacccccgagatcgccgaacgcccgaaggtacgggaccaagcgggtcggatgaactactattggaccctgctaaagcctggggacactatcatcttcgaggccaacggtaacctgatcgctcccatgtatgcgtttgccctgagcagaggattcggctctggaatcataacgagcaacgcctcaatgcatgaatgcaacactaagtgtcaaactcccttgggcgcaataaactcatccttgccatatcagaacatccacccagtcaccatcggggagtgccctaaatatgtgcgttcagccaagttacgcatggtaacgggactccggaataaccccagcattcaatctcgagggctttttggagctatcgcaggattcattgaagggggctggactgggatgatcgatggatggtatgggtaccatcatcagaacgagcagggctccggctacgcagccgatcagaagagcactcagaacgccatcaatggcatcacaaacaaagtcaacactgtgattgaaaaaatgaatatacagtttaccgcagtgggtaaggaattcaacaagctggagaaacggatggaaaatctaaacaagaaagtggatgatggctttctcgacatctggacctacaacgccgaactgctggtcctgctggaaaatgagcgcacactggatttccacgactcgaacgtcaagaatctatacgagaaagtgaaatcccagctcaagaataatgccaaggagatcggcaacggatgcttcgaattttaccataaatgcgacaacgagtgtatggagtccgtccgaaacgggacatacgactatcccaagtattcagaagagtcaaagcttaaccgcgaaaaggtggatggcgttaagctggaatctatgggtatttaccagatactggccatttatagcactgtggctagctcattagtgctgctggtgtcgctgggagcgatttccttttggatgtgtagcaacgggagtttacagtgccggatttgcatc

SEQ ID NO: 494 - DNA, 1695 bp, Influenza A virus
  misc_feature (1)..(1695): Codon Optimized Sequence Encoding H1 Hemagglutinin
atgaaggctaacctcctggtgctgctgtgtgccctggctgcagcggacgccgacacgatctgtatcggataccatgctaataattctaccgacactgtagacaccgtgctggaaaagaatgttacagtgacccatagtgttaatctcctcgaagattcacacaacggcaagctctgccgtctcaaaggaatagcacctcttcagctgggcaagtgtaacatcgccgggtggcttctgggcaaccccgaatgtgatccccttctgccagtccgctcatggtcctatattgtggaaacccctaattccgagaacggaatttgttatcccggagactttattgattatgaggaacttagagaacaactgtcttcggtctcgtcctttgagaggttcgagattttccctaaggagagctcctggcccaatcacaacactaacggtgtgaccgccgcctgctcgcatgaggggaagtcctctttctaccgcaacctcctgtggctgacagagaaggaggggtcctatcccaaactaaaaaactcatacgtgaacaaaaagggaaaagaggtcttggttctctggggcatccatcacccaccaaacagtaaggagcagcaaaatctgtaccagaatgaaaacgcatatgttagcgtagtgacctctaactataacaggcggtttactccagagattgccgagcggcccaaagtgcgagaccaggcaggaaggatgaactattattggactttgttaaaacccggagacacaattatcttcgaggcaaacgggaacttgatcgcacccatgtacgccttcgcactgagcaggggtttcggctccggcatcatcacttctaatgcctctatgcacgagtgtaatacgaagtgtcagaccccattgggagccatcaactccagtctgccctatcagaacatccatccggtgactataggcgaatgccccaagtacgtcaggtccgctaagctccgcatggtcaccggacttaggaacaacccgagtattcagagccgaggcctgttcggagccatcgcagggttcatagagggagggtggaccgggatgatagatggatggtatggctaccatcatcaaaacgaacagggcagcggatatgcagctgatcagaagtccacccagaacgccataaacggaatcaccaacaaagtgaacaccgtcatagaaaaaatgaacatacagttcaccgccgtgggcaaagaattcaataaacttgaaaaacggatggaaaatttgaataagaaggtggatgacggcttcctggatatctggacttacaatgcggagctgctcgtgcttctggagaacgagagaacgctcgacttccacgattctaacgttaagaacctgtatgagaaagttaaaagtcagctcaaaaataacgcgaaggaaatcgggaacggctgctttgaattttaccataaatgcgataatgagtgcatggaatccgtgcgaaacggcacgtacgactatccaaagtattcagaggaatcaaaattgaacagagaaaaggtcgatggtgtgaaactggagagtatggggatatatcaaatccttgcgatctactctactgtggcttcttccctggtcctgctggtgtccttgggggcaatttcattttggatgtgttctaatgggagtttacagtgcaggatctgcata

SEQ ID NO: 495 - DNA, 1695 bp, Influenza A virus
  misc_feature (1)..(1695): Codon Optimized Sequence Encoding H1 Hemagglutinin
atgaaagccaatcttctggttctgctctgcgctctagctgctgccgatgctgacactatttgtataggctaccacgcaaataattcgacggatactgtcgacacggtcctggaaaaaaatgtcacagtgactcattcagttaatctcttggaggattctcacaatggaaagttgtgtagactgaagggcattgctccattgcagcttgggaagtgtaatatcgcgggctggttactgggcaaccctgaatgcgaccccctcttgcctgtccggtcctggtcttatatcgtggagacaccaaattctgagaatggaatctgctatccgggtgactttatcgattacgaggagcttcgggagcagctgtcttcagtgtccagttttgaaagatttgagatatttcctaaggagagctcctggccaaatcataataccaatggcgtgacagccgcatgttcacacgaaggaaaaagctccttctatcggaacctgctctggcttacagaaaaggaaggctcttaccccaaactcaagaacagttacgtgaataagaaaggtaaagaggttctagtactctggggcatccaccacccgccaaacagcaaggagcaacagaacctctatcagaacgagaatgcctacgtgtccgtggtcacatcaaactataaccgcaggtttacaccagaaattgcagagcggcctaaagtccgtgatcaggcaggcaggatgaactattactggactttgctgaagccgggagacaccattatcttcgaggcgaatgggaacctcattgccccaatgtacgccttcgcgctctctcgcggctttggctcaggaattatcacgtcaaatgcttctatgcacgagtgtaatacaaaatgtcagacccctctgggcgccataaactcttccctgccttatcaaaatattcacccagtgactattggggagtgccccaaatacgttagaagcgctaaactgcgtatggtaacgggtttgcggaacaacccaagtatccagagccgcggcctgtttggcgccattgctggttttattgaggggggttggacaggaatgatcgatggatggtacggctaccaccatcagaatgaacaggggagtgggtacgccgccgaccaaaagtccacacagaatgcgatcaacgggatcactaacaaggtgaacaccgtgattgagaagatgaacatacagtttaccgcagtcggaaaggaattcaacaaacttgaaaaacgcatggagaatctgaataaaaaagtggacgacggatttttagatatatggacctataatgccgaattgctggtgctcttagaaaacgaacgaacgctggacttccacgattctaacgttaaaaacctttatgagaaggttaagagccagttgaagaacaacgcgaaggaaatcggaaacggatgcttcgaattttaccacaagtgtgacaacgagtgtatggaatctgttagaaatggcacctacgattatccaaagtactcagaagaaagcaaacttaacagggaaaaggtggatggtgtgaaactggagtccatgggtatctaccagatacttgcaatctactctacggttgcttcaagcttggtgctgcttgtgagcttgggagccatctcattttggatgtgttcaaatggcagcttacagtgtaggatctgcata

SEQ ID NO: 496 - DNA, 1680 bp, Influenza A virus
  misc_feature (1)..(1680): Codon Optimized Sequence Encoding H7 Hemagglutinin
atgaatacacagatccttgtatttgccctgatcgcaatcattcctactaatgctgacaagatttgcctcggccaccatgcggttagtaatgggaccaaagtgaacacactgacggagagaggagtagaggtagttaacgccaccgagactgtggagagaactaacatcccacggatttgttccaagggtaaacgtactgtggatctggggcagtgcggcttgttgggtaccatcactggaccgccacagtgcgaccagtttctggagttttccgccgacctgattatagaacgccgagaaggcagcgatgtctgttaccccggtaaattcgtgaatgaagaagccctccgccaaatcctgcgtgagagtgggggcattgacaaagaggcgatgggctttacatacagcgggatacgcaccaacggcgcgacgtcagcctgccgcaggagtggaagttctttctatgccgagatgaagtggctgttgtctaatactgataatgcagccttcccccagatgacaaagtcgtacaagaacaccagaaagtcacccgcactcattgtgtggggtattcaccattctgtctctactgctgagcagacgaaactgtatggttctgggaacaagctcgtgaccgtggggtccagcaactatcagcagagctttgtgccctccccaggagagaggccacaggtgaatgggttgtcaggccgtatcgatttccactggcttatgttgaatccaaacgacacagtgacattttctttcaacggcgccttcattgcaccagacagagctagctttctgcgagggaagagtatgggtatccagtctggtgtgcaggtcgacgctaactgtgagggggattgctaccatagcgggggaacaattatttcaaacctgcccttccagaatattgacagcagggcagtgggaaagtgcccccgctatgtgaaacagagatctttgttgctggccaccggcatgaagaacgttcccgaaattcctaagggccgggggctttttggggcgatagccgggttcattgaaaacgggtgggaggggctaatcgatggttggtacggttttaggcatcaaaacgcccagggcgaaggcactgcggccgactacaaatccacacagagcgccatcgaccaaatcactgggaaacttaaccgacttattgagaaaacaaatcaacagtttgagctgattgataacgaatttaatgaggtagagaagcagatcggcaatgtaataaactggacaagggacagcattactgaagtctggagctacaacgccgagttgctcgtcgcgatggagaatcagcataccatcgatttagccgactcagagatggataagctgtatgaacgcgtaaagaggcagctgcgcgagaacgctgaagaggacgggactggctgcttcgaaattttccacaaatgcgatgatgattgtatggcttccatccggaacaatacctacgaccattctaagtaccgtgaagaggccatgcagaataggatccagattgacccagtgaagctgagctcgggttataaagacgtgattttgtggttcagttttggcgcctcttgttttatccttctggcaattgttatggggttggttttcatctgcgtcaagaacggcaacatgcgctgtactatttgtatc

SEQ ID NO: 497 - DNA, 1680 bp, Influenza A virus
  misc_feature (1)..(1680): Codon Optimized Sequence Encoding H7 Hemagglutinin
atgaatacccagattctcgtcttcgcactgatagctataattccaaccaatgccgacaagatatgcttgggacaccatgcggtgtctaacggcacaaaggtgaatactctgacagagagaggagtggaggtggttaacgctacagagactgtggaaaggacgaatataccaaggatatgctccaagggcaagaagaccgtcgacctcggccagtgtggcctgcttggcactatcacaggtccccctcaatgcgatcaatttctggaattctctgctgatctgataatcgagcgccgcgaggggtctgacgtatgctatcccgggaaattcgtgaatgaggaggctctgagacagatattgcgggagtcggggggcatcgataaagaagctatgggattcacttactcggggatcagaacaaacggagctacatctgcgtgtcggcggtctggcagctcgttttatgccgagatgaagtggctgctctccaatacagacaatgccgcattcccacaaatgacgaaaagctataaaaatactcgcaagtcacccgcactaatcgtgtggggcatccaccacagcgtgtccaccgcagagcagaccaaattgtatggtagcggcaataagctggttacagtgggatcctccaactaccaacagtccttcgtcccaagcccaggggcccgaccgcaagttaacggtcagtccggacgcattgattttcactggctgatgcttaacccaaacgacacagttaccttttcgtttaacggcgctttcattgccccagatcgggcctcttttctgcggggtaagagcatgggaatccagtcgggggtacaggtcgacgcgaattgtgaaggcgattgttaccattctgggggcactattatatcaaatcttccattccagaatattgactcgcgcgctgtgggcaaatgccccaggtacgttaagcagcgatcactgctcctcgccacaggtatgaaaaatgttccagagattcccaagggcagggggctgttcggtgcaatcgccggctttatagaaaatgggtgggagggactcatcgatggttggtacggttttaggcatcaaaacgcccagggggaggggacggctgccgattacaagtctacccagtcagctatagaccagatcactgggaaactaaacaggctgatcgagaaaaccaaccagcagttcgaactgattgacaacgagttcaacgaggttgaaaagcagattggtaacgtgattaactggaccagagactctatcaccgaggtctggagctacaatgcagaactacttgtggctatggaaaaccagcatacaattgatcttgctgactctgagatggacaagctttatgagagggtgaagagacagcttcgggagaacgctgaggaggatggaaccggttgtttcgagatctttcacaaatgcgatgacgattgcatggctagcattaggaataacacctatgaccactctaaatacagagaggaggctatgcagaatcgcatccagatcgacccagtgaagctgtcctctggatacaaggacgtaatcctgtggttctcatttggggcttcgtgcttcatcttgctggcgattgttatgggcttagtgtttatctgcgttaaaaacgggaacatgcggtgtacaatctgtatc

SEQ ID NO: 498 - DNA, 1680 bp, Influenza A virus
  misc_feature (1)..(1680): Codon Optimized Sequence Encoding H7 Hemagglutinin
atgaacacacagattctggtctttgccttgatcgcaataattccaactaatgccgacaaaatttgtttaggtcatcacgccgtttcaaatggaactaaggtcaacaccctgaccgagaggggcgtcgaggtcgtgaatgccacagaaactgtggagagaaccaacatccctcgcatctgtagcaagggcaagaagactgtcgatcttggacagtgcggtctcctgggaacgattacaggccccccacagtgcgaccaattcctagaattctctgccgacttaatcatcgaaaggcgtgagggatctgacgtgtgctatccgggaaagttcgtgaatgaggaggccctacggcagattctgcggaaatccggaggtatagacaaagaggcaatgggcttcacctacagtgggatacgcacaaatggggccacatccacttgtcggagaagcggctcttccttttatgccgagatgaagtggctcttatccaacacagacaatgccgccttccctcagatgacgaagagctacaaaaacaccaggaagtctccagcaatcattgtttggggcatccaccatagcgtctccaccgctgagcaaaccaaattatatgggtccgggaataaattggtcacagtcggtagctccaactaccagcagtcatttgtcccctcaccgggggctcgcccacaagtaaatggtttgtctggcagaatcgactttcattggctcatgctcaatccaaacgacacggtgactttcagctttaacggggcatttattgcccccgaccgagcatgttttcttagaggcaaaagcatggggattcagagcggagtccaggtcgacgcggattgcgagggtgactgctaccactcagggggtaccattatctccaaccttccttttcagaatatcgattcgagagctgtgggcaagtgccctcggtatgttaaacagcgatccctccttctggccactggtatgaagaacgtgcctgagatacccaaagggaggggcctgtttggggctatcgctggatttattgagaatggttgggagggccttatcgacggctggtacggctttaggcaccagaacgcgcagggcgaaggcacagctgccgactacaaaagcacccagagcgcgattgaccagatcaccggcaaattgaacaggcttatcgaaaaaacgaaccaacagtttgagctaattgacaatgagtttaacgaggtcgagaggcagattgggaacgtcatcaactggacaagagacagcattaccgaggtgtggtcttacaatgcagagttgctagtggccatggaaaaccaacatacgatcgacctcgcggattctgagatggataagctctatgaaagggtgaaaaggcagctgcgggaaaatgctgaggaagacggaacaggatgttttgaaatcttccacaaatgtgatgatgactgtatggcctctataaggaacaacacctatgatcattccaagtatcgagaagaggccatgcagaaccgtatccagattgaccctgtaaaactcagttcagggtacaaggatgtgatcctgtggttcagctttggcgcaagctgtttcattcttctcgcgattgtgatggggctagtgttcatttgtgtgaaaaatggaaatatgagatgtaccatttgtatc

SEQ ID NO: 499 - DNA, 1680 bp, Influenza A virus
  misc_feature (1)..(1680): Codon Optimized Sequence Encoding H7 Hemagglutinin
atgaacacccagattctggtcttcgctctgattgctattatcccaaccaatgcagacaagatctgtctggggcaccatgctgtgtcgaacggcacgaaagtgaacacactgaccgaaagaggagtcgaggtggtgaacgcgaccgagacagtggagcggacaaacatcccacgtatctgctccaagggcaagcgtacagtggacttggggcaatgtggcctccttggaacgatcacaggaccaccgcagtgcgaccagtttctggagttttctgccgatttaatcatcgaaaggcgggagggttccgacgtttgttacccggggaagttcgttaacgaggaagccctgagacagatcctacgtgagagcggcggtatcgacaaggaggctatgggctttacatatagcggaattagaacaaacggcgctaccagcgcctgccgccgcagcggttcatctttttatgccgaaatgaagtggctgctctccaacaccgacaacgccgcttttccacagatgacgaaatcctataagaataccaggaaaagtccagctctgattgtgtgggggatacaccactctgtgtcaacagcggaacagacaaagctctatggaagcggaaacaaactcgtaacggtcggcagttccaactatcagcaatcctttgtgccaagtccaggcgcgcgtcctcaggtgaacggcctaagtgggagaatcgatttccattggttaatgcttaatccaaatgacaccgtgacctttagctttaacggcgcctttattgctcccgaccgagcttctttccttagaggtaagtcaatgggtatccagagcggcgtgcaggttgacgcaaactgtgaaggcgattgttaccactccggaggcactatcattagcaacttgccatttcagaacatagattcacgcgctgtgggaaagtgccctaggtacgtgaagcagaggtccctgttgctcgctacgggcatgaagaacgtgccagagattcccaaaggcagagggttgttcggtgccattgctggtttcattgagaatggttgggagggcctgatcgacgggtggtacggtttccgtcaccagaatgctcaaggggagggtacagcagccgactataaatccacccagagcgcaatcgatcaaattaccggcaagctaaataggctgattgaaaaaactaatcagcagttcgagctcatagacaatgagttcaacgaagtggaaaagcagattggcaacgtcatcaattggaccagagattccatcaccgaggtgtggtcttataatgccgagctgttggttgccatggaaaatcagcatacaatagacctggccgactccgaaatggataaactgtacgagagggttaaacgccaactgcgtgagaatgcagaggaagacggaacaggttgtttcgagatctttcacaaatgcgacgacgactgcatggcctccataaggaataatacatatgatcatagcaaatacagggaggaggcaatgcaaaaccggattcagattgatcctgtgaagctgagcagcggctacaaggacgttattctttggttcagtttcggtgcatcatgcttcatactcctggcaatagtgatgggtctggtgttcatctgcgtgaaaaacggaaatatgaggtgcaccatatgcatc

SEQ ID NO: 500 - DNA, 1680 bp, Influenza A virus
  misc_feature (1)..(1680): Codon Optimized Sequence Encoding H7 Hemagglutinin
atgaatacccaaatactcgtctttgctctcatcgctatcattcctacgaatgccgacaaaatatgcctaggacatcacgccgtgagcaatgggacaaaggtgaataccttaaccgaaagaggcgtggaggtcgtgaacgccacagagactgtggagcgcaccaatatacctagaatctgctcaaagggcaagaaaacagtggacctaggacagtgtgggcttctggggacgatcactgggccaccacagtgcgaccagttcctggagttcagcgcggacctgatcatcgaacgccgagagggctctgatgtgtgctaccctggcaagtttgtgaacgaggaggctcttaggcagattctcagggaatccggcggaattgacaaggaagctatgggcttcacttatagtggaatccgcaccaatggggcaacgtccgcttgtaggagatccgggagcagtttttatgcagaaatgaaatggctgcttagtaacacggacaacgccgcttttccgcagatgactaagtcctacaagaacacccgcaaatcaccagctctgattgtgtgggggattcaccattccgtgagcacagccgagcagacaaagttgtatggctctggaaataaactcgtgactgtgggcagttcgaactaccagcagtcttttgtgccttctcccggagcccgtccccaggtcaacgggcagtccggaagaattgatttccactggttgatgctcaacccgaatgatacagtgacttttagcttcaacggcgcttttattgcccctgatcgtgccagcttccttaggggcaaatccatggggattcagtcaggagttcaggtagatgccaattgtgagggagattgttaccactcagggggtacgatcatcagcaacttgccatttcagaacatcgacagtcgggcagtgggcaaatgcccacgttacgtgaagcaacggagtctcctgttagccacagggatgaaaaatgttccagagatccctaagggccggggactgttcggggccattgccggatttatcgagaatggatgggagggacttattgatggttggtacggctttcggcatcagaatgcccaaggggagggcacagctgccgactataaatcaacccagtctgcaatagatcaaatcaccggtaagctgaatcgccttatcgaaaaaacgaaccaacaattcgagctgatcgataacgaattcaatgaagtggagaaacagattgggaatgttattaactggacaagagacagcataaccgaagtctggtcctataatgccgagttacttgtggccatggaaaaccagcatacgattgacttagccgactccgagatggacaagttgtatgagcgggtgaagagacagttacgggagaacgccgaagaggacgggactggttgttttgaaatcttccataagtgtgacgacgactgcatggccagtattcgcaataacacctacgaccatagcaagtacagggaagaagccatgcagaatcgtattcagatcgatcctgtcaaacttagtagtgggtacaaggacgttatcctgtggttttcttttggggcctcctgtttcattcttctggctattgtaatgggactggttttcatatgtgtgaaaaatggtaacatgcggtgcactatatgtatc

SEQ ID NO: 501 - DNA, 1680 bp, Influenza A virus
  misc_feature (1)..(1680): Codon Optimized Sequence Encoding H7 Hemagglutinin
atgaatactcagattctagtgttcgctttgatagctataatcccaaccaacgccgacaaaatatgcctggggcaccacgcagtatccaacgggaccaaggtcaataccctgaccgaacggggtgtggaagtcgtgaacgccacagagaccgttgagagaacaaacatccctagaatttgtagcaaagggaagaggactgtcgacttggggcagtgcgggttactgggaacaatcactggcccaccccagtgtgaccagttcctcgagttctctgctgatcttatcattgagagaagagagggcagtgacgtgtgttatcctggaaaattcgtaaacgaggaggcgcttaggcagattctgcgcgaatcaggaggtatcgataaagaggcaatggggtttacttacagcggtatccgaaccaacggcgctacatctgcatgccgcaggtctggctcatctttctatgcagagatgaagtggttgctctctaacaccgataatgcggcatttcctcagatgaccaagagctacaagaacaccagaaaatcccccgcgttgatcgtgtggggcatccaccattcagtgtccaccgctgagcagacaaaactctacggatctgggaacaagttggtgactgtggggtcctctaactaccagcaatcgtttgtgccatccccaggggctagaccccaggtcaacggtctctctggccggatcgacttccactggcttatgcttaacccaaacgataccgtcacctttagctttaatggtgctttcattgcccccgaccgggcaagcttcttacgaggcaagagtatgggaatacagagtggggttcaagtggatgccaactgcgagggcgactgttaccacagcggcggcaccataatttcaaatctgccgttccagaatatagactctcgagctgttgggaagtgcccccgatacgtaaagcagcgctctctgttactggccaccggcatgaaaaatgttcctgagataccgaagggacgtggcctcttcggggccatcgccgggttcatcgagaacggctgggaaggactgatcgatggatggtacggattcaggcatcagaatgctcagggagaagggacggctgcagattataagtctacacagtccgccatcgatcagatcaccggtaagcttaatagaatcatagagaagacgaaccagcagttcgagctgatcgataacgagtttaatgaggtcgaaaagcagattggcaacgtgataaattggacaagagacagtattactgaagtgtggtcctacaacgccgagcttttggtggccatggaaaaccaacacaccatcgacttagcagattccgagatggataaactttacgagcgagtaaaaagacagctcagggagaatgctgaagaagacggcacaggatgtttcgagattttccacaagtgtgatgacgattgcatggcatcaattcgcaacaacacttacgatcatagcaagtatcgcgaggaggccatgcagaaccgcatccaaattgatcctgtcaagctaagttccgggtataaagacgtgattttgtggttttcttttggcgctagctgctttattctactggctattgtcatgggcttggttttcatctgcgtgaaaaatggcaatatgcgctgcactatatgtatc

SEQ ID NO: 502 - DNA, 1680 bp, Influenza A virus
  misc_feature (1)..(1680): Codon Optimized Sequence Encoding H7 Hemagglutinin
atgaatacacaaattctggtcttcgccttgattgccattataccaactaatgccgataagatttgcctcgggcaccatgccgtctccaatggcacaaaagtcaacacactgactgaacgaggggtcgaggtggtcaacgccactgaaaccgtggaaaggaccaacatcccccgcatttgcagcaagggtaaaaaaacggtagacctgggacagtgtgggctgctaggtactattaccggccccccacaatgtgaccaattcttagagttctccgctgacttgataattgaacggagagagggttctgacgtgtgctaccctgggaagtttgtaaatgaagaagcccttcgacagattctcagggagtccggcggtattgataaggaggccatgggatttacgtacagcggaattcggactaatggggccacttcggcctgccggcgctctggttcctccttttatgcagagatgaaatggctcctatccaacacggataacgccgccttcccacagatgacaaaatcctacaagaacactcggaagagcccagcgctgattgtgtggggtattcaccatagcgtgtccactgccgagcagacgaagctgtacggaagtggcaacaaattggtcactgtaggctcatctaattaccagcagagctttgttccttcccctggggcaaggccacaagtgaatggccaaagtggtagaatcgatttccactggctcatgttgaatcctaatgacacggtaactttcagtttcaacggcgctttcattgcacccgaccgggcttcatttctccgggggaagtccatggggatccagtcaggagtccaggtcgatgctaattgtgaaggcgattgttaccactccggtgggaccatcattagcaatctgccatttcagaacatcgattccagagcagtcggcaagtgccctagatatgtgaagcagaggagcctgctgctagctacgggtatgaaaaatgtgccagagatcccaaaggggcggggtcttttcggtgccatagctggatttatcgagaatggctgggagggtctgatcgacggatggtacgggttcaggcatcagaatgcccagggggagggcactgccgccgactataagtctacacaaagcgctattgaccaaattaccggtaagctgaacagactgatcgagaagacaaaccagcagttcgagctcatcgataatgaattcaacgaggtagaaaagcaaatcggcaacgtgattaactggaccagggattctatcactgaggtgtggtcatacaacgcggagctgctcgttgccatggaaaatcagcacactattgacctggccgacagcgaaatggacaagctgtacgaaagagtgaaacgacagctgcgggagaacgccgaagaggacgggactggttgtttcgaaatcttccataagtgcgatgacgactgtatggcttcaatcaggaacaacacatacgaccactctaagtacagagaggaggctatgcagaatcgtatccagattgaccctgtaaaactctcctctgggtacaaagacgtgatcctgtggttttcgttcggcgcatcctgcttcatcctgctcgcgatcgtcatgggattagtgttcatttgcgtcaaaaatggcaatatgaggtgtaccatttgcatc

SEQ ID NO: 503 - DNA, 1680 bp, Influenza A virus
  misc_feature (1)..(1680): Codon Optimized Sequence Encoding H7 Hemagglutinin
atgaatactcagatcctagtgtttgctctcattgctataatccccacaaatgctgacaagatctgcttgggccatcacgccgtgagtaacggcactaaggtgaatacgctgacggaacggggtgtagaagttgtaaacgccaccgaaacagtcgaaaggacaaacatcccgcgcatctgcagtaaaggtaaaaagaccgttgacctcggccaatgcggactgctggggactatcaccggacccccccaatgtgatcaatttctggagttcagtgcggacttgataatcgaaagacgggaaggttccgatgtgtgctatccaggcaagttcgttaatgaggaagcactccggcaaattcttcgggaaagcgggggcatagacaaggaagccatgggctttacttacagcggaatccgcacaaacggagcaacatccgcttgcaggagaagtggtagttctttttatgccgagatgaaatggttgctgagcaataccgacaacgcagcctttccacagatgaccaagagctacaaaaatacaagaaagtccccagctctgattgtgtggggaatacaccatagcgttagcacagccgaacaaacaaagctgtacggttcaggaaataaacttgtgacggtaggatccagcaattatcagcaatctttcgtgccatcaccaggcgctcggcctcaggtcaacgggcagtcgggccgtatagattttcattggctgatgctgaatcctaatgatactgtgacctttagctttaacggggcgttcatagcccccgatcgggcatcttttctcaggggtaaaagcatgggtattcagagtggagtgcaggttgacgccaattgcgagggagattgctatcattccggcgggaccattatttccaacctccccttccagaacatcgacagccgagctgtcggcaaatgccccaggtatgtgaaacaacgcagcctgttgttagcaacagggatgaagaatgttcctgaaattccaaaagggcgaggtctgttcggcgctatcgcagggttcattgagaacggttgggagggcctgatcgatggctggtatggctttaggcaccaaaacgcacagggcgaagggactgccgcagactacaaatctacacagtcagcgattgatcaaatcactggcaaactgaaccgcctcattgagaagaccaaccagcagttcgaactgatagacaatgagttcaatgaggttgaaaagcagataggtaatgtgataaattggaccagagatagtataactgaagtctggtcctataacgccgagttacttgtcgctatggagaaccagcacacaattgacctggcggacagcgagatggataagctgtacgaacgcgtaaaaagacaactgcgcgagaatgcggaggaggacggcaccgggtgtttcgagatctttcacaagtgtgatgatgattgtatggcctccattagaaacaacacctatgatcactccaaataccgggaggaagcaatgcagaaccgcatacagattgaccccgtcaagttgagttccgggtataaagacgtgatactctggttcagttttggtgcctcttgctttatcctgcttgccatcgtgatgggactggtgtttatttgcgttaaaaacgggaatatgcgttgtacgatttgtata

SEQ ID NO: 504 - DNA, 1680 bp, Influenza A virus
  misc_feature (1)..(1680): Codon Optimized Sequence Encoding H7 Hemagglutinin
atgaatacccagattcttgtgttcgccctcattgccatcatccccaccaatgccgacaagatttgcttgggacatcacgctgtgagtaatggcacaaaagtaaatacgttaaccgaacgcggggttgaagtggtgaatgctacagagacggtagagcgcacaaacatcccgagaatttgctccaaaggcaaaaagactgttgaccttggccagtgcgggctgctgggtacgattactgggccacctcagtgcgatcagttcctagaattttcagcagatttaatcatcgaaagacgtgaaggatcagatgtgtgttatcccggaaagttcgtgaatgaggaggctttgagacagatcttgcgtgaatctgggggcatagataaggaagccatggggtttacttattctggaatccgcactaatggggccaccagcgcatgtaggcgctccggatcctcattctatgccgagatgaagtggcttctcagtaacacagataatgccgccttcccccaaatgacaaagagctacaagaatacacggaaaagccccgccctgatcgtatgggggattcatcattctgttagcactgccgagcaaaccaaactgtacggctcaggaaataagctcgtgacggtagggtcatcaaactaccagcagagcttcgtaccttcccccggcgctagacctcaggtcaacggtcagtccggacgaattgatttccactggttaatgctcaacccaaatgacaccgtcacattcagttttaacggtgcctttattgctcctgacagagcctcttttctgaggggcaagtccatgggcatccagagcggggtacaggtcgacgccaattgcgagggcgactgctaccattcaggggggacgatcattagtaacttaccctttcaaaacattgattcacgggccgtaggcaagtgtccgagatacgtcaagcagcggagcttgctgttggcaactggcatgaaaaacgttcccgaaatccctaagggccgaggtctttttggggcaattgcgggcttcatagagaatggttgggagggactgatcgatgggtggtatggcttcagacatcagaacgcacagggtgagggtaccgctgctgactataagagcacccagagcgcaatagatcagatcactggcaagcttaaccgacttatcgaaaagaccaaccagcagtttgaattgattgacaacgaatttaacgaagttgagaagcaaattgggaacgttattaattggacaagggattccatcacagaggtttggagttacaatgcggagttattagtggcaatggagaaccaacatactattgaccttgcggatagcgagatggacaagctgtacgagagggtcaagcgccagttacgggaaaacgcggaagaggatggaactggatgtttcgagatcttccacaaatgcgatgacgattgcatggcgtcgatccgaaacaatacctacgatcacagtaaatacagggaagaggcaatgcagaaccgaattcagattgatcccgtgaagctcagctcagggtacaaggacgtgattctgtggttttcatttggagctagctgctttatactgctggctattgttatgggcttggtattcatctgtgtgaagaatggtaacatgaggtgtacaatttgcatt

SEQ ID NO: 505 - DNA, 1680 bp, Influenza A virus
  misc_feature (1)..(1680): Codon Optimized Sequence Encoding H7 Hemagglutinin
atgaatactcagatcctggtgtttgctctgatagctatcatccccaccaacgccgataagatttgcctgggccaccacgcagtgagtaacgggacaaaagtcaacactctaactgagcgcggcgttgaagttgtaaatgccactgaaactgttgagagaactaatataccccgcatttgctcaaaaggcaagaggactgtggatctcggccagtgtgggcttctggggaccataactggtccgccccaatgtgaccagttcttggagttttccgcagacctaattatcgagcgtcgcgaaggctccgatgtgtgctaccccggcaagtttgtcaatgaagaagccctgaggcagattctgcgagaaagcgggggtatagacaaagaagctatgggctttacttatagcggaattcgtacaaacggcgctacatccgcctgtcgacggtctggttctagcttctatgctgagatgaaatggttgcttagcaacacagacaatgccgctttcccccagatgactaaaagttataaaaatacccggaagagccccgcacttatcgtatgggggatccatcacagtgtgtcgactgccgaacagaccaagctctacgggagcggctccaagctggtgacagtggggtcttctaattaccaacaatcctttgtcccttcccctggcgcccgcccccaagtgaatgggctaagcggaaggattgactttcattggctgatgctgaatcccaacgatacagtgacgttcagctttaacggggcgtttattgcccctgaccgtgcaagttttctccgcgggaaatccatgggcatccaaagcggcgtccaagtggatgcaaactgcgaaggagactgctatcactctggaggaactattatttctaacctgcctttccagaacatcgactcaagggccgtggggaaatgcccgcgctatgttaaacagagaagcctgttgcttgccacaggtatgaagaacgtgcccgagatccctaagggcagagggctgttcggcgcaatcgcagggttcattgaaaacggatgggagggcctcatcgacggatggtacggttttcggcaccaaaacgcacagggggagggcacagcggcggattataagagcactcagagtgccatagatcagattacggggaagctcaatagacttatagagaagaccaatcagcaattcgagctgatcgataacgagttcaatgaggtagaaaagcagattgggaatgtcatcaactggacaagagatagtataacagaggtgtggagctacaacgccgagttacttgtggccatggaaaaccagcacacaatcgacctggctgatagcgaaatggacaagctgtatgaaagagtcaagagacagcttcgagaaaacgcagaggaggacggaaccggctgcttcgagatttttcacaaatgtgacgatgattgcatggcgtcaatccggaacaacacctatgaccactctaagtatcgagaggaggcgatgcagaaccggatacagatcgatcctgttaagctttcatcaggttacaaggacgtaatcctgtggttctcgttcggcgcatcctgctttatccttctggcaattgtgatggggctcgtattcatctgcgtgaaaaatggcaatatgagatgtactatttgcatt

SEQ ID NO: 506 - DNA, 1680 bp, Influenza A virus
  misc_feature (1)..(1680): Codon Optimized Sequence Encoding H7 Hemagglutinin
atgaatacacagatccttgtgttcgcactgatcgcgattatccccaccaacgcagacaagatctgtttaggccaccatgctgtgagcaatgggacaaaagtcaacacgctgacagagcggggagtggaggtggtaaacgctactgaaacggtcgagagaactaacattcctagaatttgttcaaaagggaaaaggaccgtggatctgggccagtgtgggctgctgggaacaatcactgggccaccacaatgcgatcagtttttagagttctcggccgacctaatcatagagcgcagagagggctccgatgtatgctatcccgggaagtttgtgaatgaagaagctttaaggcagattcttagagaatccggtgggattgacaaggaggcaatggggtttacatactccggtattagaacaaacggggccacctccgcgtgcaggagaagcggctcctctttttatgctgagatgaaatggctgctgtcaaacaccgacaacgccgcatttccccaaatcaccaagtcctacaagaatacaagaaagtctccagccctgattgtttgggggatacaccactcagtgtccaccgctgaacagaccaagttgtatggtagcggaaacaagctggtgaccgtcgggtcctcaaattatcagcagtcatttgtcccatctccgggcgctaggcctcaggtgaatgggctgagtggacgcattgacttccactggcttatgctgaatcctaatgacacagttacatttagtttcaacggggcatttattgcgccagatagagccagtttcttgcgcggcaaatctatgggaatccagagcggcgttcaagtggacgccaactgtgagggggactgctaccacagcggcgggacaattatcagcaacctgccattccagaatattgattcacgggctgtgggaaagtgtcctaggtacgtcaaacagcggtctctgctgttagcaaccggaatgaagaatgtacccgagatccctaaaggccgagggttgttcggcgcaattgcgggcttcattgagaatggttgggagggtctcatcgatggttggtacggcttcagacaccagaatgcccaaggcgaaggaactgcagccgactataagtcaactcaaagcgcaatcgaccagatcacagggaaactgaatcgcttgatcgaaaagaccaaccagcaattcgagctgatcgacaatgagtttaacgaggtcgagaagcagatcggaaatgtgattaattggactcgagactcaattaccgaggtttggagttacaatgccgaactgctggtggccatggagaatcaacataccatagatctcgccgatagcgagatggataaactgtatgaacgagttaagcgacaactgagagaaaacgccgaagaagacggaaccgggtgctttgaaatcttccacaaatgcgatgatgattgtatggcttcaattcgcaacaacacctacgatcacagcaagtaccgagaagaggccatgcaaaaccggattcaaatcgatccagtgaagctgagttctggatataaggatgtgattctgtggttttcatttggggctagctgtttcattcttcttgccatcgtgatgggtctcgtgtttatttgtgtcaagaatgggaacatgcgctgcacgatatgcatc

SEQ ID NO: 507 - DNA, 1680 bp, Influenza A virus
  misc_feature (1)..(1680): Codon Optimized Sequence Encoding H7 Hemagglutinin
atgaacacccaaattctagttttcgcccttatcgccatcataccgacaaacgcagacaaaatatgtctcggacaccacgcggtgagtaatggcaccaaggtgaacactcttaccgagcgaggggtggaggtggtgaatgcaacagaaaccgtggagcgcaccaacatcccccggatttgttcaaagggaaaaaagacagtcgacctggggcagtgtgggctcctgggcactatcactgggcccccgcagtgcgaccaattcctggagtttagcgcagacctgatcatcgaaagaagggaggggtcagacgtgtgttacccgggaaagttcgtgaacgaagaggcacttcgccagatattaagagagagcggcgggattgataaagaagctatgggcttcacctattctggcattaggaccaatggcgccacaagtgcctgtaggagatcaggctcgagcttctacgctgagatgaaatggctcctgtcgaacacagacaacgccgcttttcctcagatgacgaaatcctataaaaacacgcggaagtctcctgcgctcattgtgtggggaattcatcacagtgtgtctaccgctgagcagacaaagctttacggttccggaaataaattagtgacagttggctctagtaactatcagcaaagtttcgtaccatccccgggagcgagaccgcaggtaaatggacagtccgggcggatagatttccattggctcatgctgaatcctaatgacaccgtcacattcagctttaacggggcattcatcgcacccgatcgagctagttttcttcgcggcaagtctatgggaattcaatctggcgtacaggtggatgccaattgcgagggtgattgctaccactctggcggtaccatcatctcgaacctcccttttcaaaacatcgatagcagagccgtgggcaagtgccctcgatatgttaagcagagaagcctgctgctcgcaaccggcatgaagaacgtgcctgagattcctaagggccgcggcttattcggcgccattgctggcttcatcgaaaatggctgggaaggtttaatcgatggatggtatgggttccgccatcagaacgctcaaggtgagggcactgccgccgattacaaaagcacccagagtgcaatcgaccagattactggtaagcttaatcgactaattgagaaaaccaaccagcagttcgaactgattgataacgagtttaatgaagtcgagaagcagattggaaacgttatcaattggacccgagacagtataactgaggtgtggagctacaacgccgagctcctcgtggctatggagaaccaacatacaatcgatcttgcagattctgaaatggataagctatacgaaagagtaaagcgacagctccgggaaaacgcagaggaagacggaactggatgtttcgagatttttcacaagtgcgacgacgattgcatggcaagcattagaaataacacatacgaccactcaaagtaccgcgaggaggcgatgcagaataggatacagatcgaccctgtaaagctgagctctgggtacaaggacgtgatcttgtggttttctttcggcgcatcatgcttcatcttgctggcaatcgtgatgggcctggtctttatttgcgtaaagaacggcaatatgcgctgtacaatctgtatc

SEQ ID NO: 508 - DNA, 1680 bp, Influenza A virus
  misc_feature (1)..(1680): Codon Optimized Sequence Encoding H7 Hemagglutinin
atgaatactcagatactggtgttcgcactcatcgcaattatacccactaatgccgataagatttgtttaggacatcacgccgtcagtaacggaactaaggttaacacactaacagagcgaggcgtcgaagtggttaatgcaactgagacggtcgagcgcacaaacatccctcgtatttgcagcaaaggaaagaaaaccgtcgatctgggacagtgcggactcctggggaccataaccggccctccccagtgcgatcagtttctggagttctcagcagatcttataatcgagcgacgggaaggttccgacgtatgttatcccggtaaattcgtcaacgaagaagccctgagacagatcctgcgggagagtggaggaattgacaaggaggccatgggatttacctacagcggcattagaacgaatggggccacatctgcctgccgacgcagcggcagctcattctacgccgagatgaaatggttactgtccaataccgacaacgccgcgttcccgcagatgaccaaatcttacaagaacactcgaaaatcccccgcacttattgtgtggggcatccaccatagtgtgtcaaccgctgagcagactaaactctacggttctggtaacaaactcgtgactgtgggaagctcaaactaccagcaaagctttgtgccctctcccggggccaggccacaggtgaacggacagtccggacgcatagacttccactggctgatgctaaatccgaacgacaccgtcaccttcagttttaatggggctttcatcgcccctgacagagctagcttcctgcgcggtaagagcatgggtattcagagcggggtgcaggtcgacgccaactgcgaaggtgattgctatcattcagggggcacaattatctccaacctcccatttcagaacatcgatagccgcgcagtcggtaagtgtccacgatacgttaaacaaaggtcactgctccttgccactggcatgaaaaacgtcccggagatcccgaagggccgcggactctttggggccatcgctgggttcattgaaaatggttgggaggggctcattgacggatggtatggctttaggcaccagaacgcccaaggagaggggaccgcagccgattataagagcacacagtctgccattgaccagataaccggtaaacttaaccggttaatcgaaaaaactaaccagcagttcgaattaatcgacaacgaatttaatgaagtcgagaaacagatcggcaacgtcatcaactggacccgagatagcataactgaagtgtggtcctacaacgccgagctgctcgtggctatggagaatcagcataccatcgacttggccgacagtgaaatggataagctgtacgagagagttaagcgccagctgagagagaacgcagaagaggacgggaccggctgctttgagattttccataagtgcgatgacgactgtatggcaagcattcgcaataatacttacgatcactccaaatatagggaggaggccatgcaaaaccgcattcagattgatccggtgaagttgtcaagtggatataaggatgtgattctctggttctccttcggggcctcctgttttattcttctcgcaatcgttatgggcttggtcttcatctgcgtaaaaaatgggaatatgagatgtactatctgtatc

SEQ ID NO: 509 - DNA, 1680 bp, Influenza A virus
  misc_feature (1)..(1680): Codon Optimized Sequence Encoding H7 Hemagglutinin
atgaacacacaaattcttgtatttgcccttatagcaatcattccaaccaacgcagacaagatatgcctggggcaccacgccgtctctaacggtacaaaggtaaacacactaaccgaacgcggtgtcgaggtagtgaatgcaactgagaccgtggagcggaccaacataccaagaatctgctccaaagggaagagaacggtggatctaggacagtgcgggctgctcgggactatcactggaccacctcagtgtgatcaatttttagagttctcggcagacttaatcatcgaacggcgggaaggatctgatgtttgctaccctggcaagtttgttaatgaagaggcgctgcgacagattttgcgcgaatccggtggtatcgataaagaagcaatgggcttcacttatagtggcattcggaccaatggagccacaagcgcatgccgaaggagcgggtccagcttttacgctgaaatgaaatggctcttgagtaatacagataacgccgcctttcctcaaatgacaaaaagctataagaatacgcgaaaaagccctgctctaatcgtctggggtatccaccactctgtgtctacagccgaacaaaccaagctgtatggcagcggctcaaagctggtaacagtgggatcaagcaattaccagcagagttttgtgcctagccctggagctagaccgcaggtgaacggcctttcaggtcggatagactttcactggcttatgttaaatccaaatgacacggtgaccttctctttcaacggggcatttatcgcaccagatagggcatcttttctgcgggggaagagtatgggcatccaatccggagtgcaggttgatgcaaattgcgagggggattgttatcactccggcggtacaataattagtaacctcccatttcagaatattgatagtcgtgccgtcggaaaatgtcctcgctatgtcaagcagagatcgctgttacttgccaccggcatgaaaaatgtgcccgaaatcccaaagggccgaggtctgttcggggctatcgcaggcttcattgaaaatggatgggaaggcctgatcgacgggtggtacggcttccgtcatcagaacgcacagggggaagggactgcagcggattataagtccacccaaagcgctattgaccagatcaccggcaagctcaatcggctcatagaaaaaactaatcaacagtttgagttgatagataatgagtttaacgaggtcgagaagcagattgggaatgtgatcaattggaccagagactcaataactgaggtgtggtcatacaatgcggagttgttggtcgctatggaaaatcaacacacaatcgacctggctgactcagaaatggataagctgtacgagcgggtcaagagacagctgcgcgagaatgccgaggaagatggaacaggttgctttgaaattttccataaatgcgatgatgactgtatggcaagtattcggaacaatacttacgatcacagtaagtatagagaagaagcaatgcaaaacagaattcagattgatccggtgaagctgagctcaggatacaaagatgttatcctatggttttcttttggggcctcatgctttatcttattggccatagttatggggctagtatttatctgcgtaaaatcaaggaatatgaggtgcaccatctgcatt

SEQ ID NO: 510 - DNA, 1680 bp, Influenza A virus
  misc_feature (1)..(1680): Codon Optimized Sequence Encoding H7 Hemagglutinin
atgaatacacagatcttggtttttgccctcatcgccattatccccacaaatgccgacaaaatttgcttgggccaccacgccgtgtccaatggtacaaaagtcaatacactgaccgagaggggagtggaggtggtgaatgccacagaaaccgttgaaagaacgaatattcctagaatttgttctaaagggaaaagaaccgttgatctcgggcaatgcggtctgttaggcacaatcacaggccctccccagtgtgatcaatttcttgagttcagtgcggatcttatcattgagagacgggaagggtctgatgtctgttaccccggcaagtttgtgaacgaggaagccctgcgccagatcctcagagaatctgggggtatcgataaggaagctatggggtttacttattccgggatcaggactaatggggccaccagcgcctgccggcggtccggcagctcattctacgccgagatgaagtggctgctgtccaataccgacaatgcggcctttccgcagatgaccaagagctataaaaacacgcgcaaatcacccgctttaatcgtctgggggatacatcattcagtgagcactgccgagcaaaccaagctgtatgggagcggcagtaaattggttactgtaggtagctctaactaccagcagtctttcgtcccaagcccaggagcccgtccgcaggtgaatggactcagtggaaggattgattttcattggctaatgctcaacccgaacgatactgtgacgttttcatttaatggcgcatttatcgcgcccgatcgagccagcttcctccggggtaagagtatggggatccaatcaggagtgcaggtcgatgctaactgcgagggagactgttaccattccggcggcactattatcagcaatctgcccttccagaatatcgactccagagccgtgggaaagtgtccaaggtacgtgaaacagaggagcttactgcttgccacagggatgaagaatgtccccgagattcccaaaggaagggggctgttcggagccatcgcagggttcattgagaacgggtgggaaggcttaatcgatggctggtacggcttcagacaccaaaatgcacagggcgaaggaaccgccgccgattacaagtcaacgcaatccgctatagatcagataaccggaaagctgaacagactcatcgaaaaaacaaaccaacagttcgaacttatagacaacgaattcaacgaggtggaaaaacagatcgggaacgttatcaattggacacgagactcaatcacagaggtatggtcctacaacgctgaactcctggttgcgatggagaatcagcacaccattgacttagccgactctgagatggataaactgtacgagagagtgaaaaggcagctccgagagaacgcagaagaggatggtacaggatgcttcgaaatctttcacaaatgcgacgatgattgtatggccagcatcagaaataatacatatgaccattccaaatatcgggaagaagcaatgcaaaaccggatccagatcgatcctgttaaactcagcagcggttacaaggacgtgattctgtggttctccttcggcgcatcatgttttattcttcttgctattgtgatgggactagtatttatatgcgtgaagaatggcaacatgagatgtaccatttgcatc

SEQ ID NO: 511 - DNA, 1680 bp, Influenza A virus
  misc_feature (1)..(1680): Codon Optimized Sequence Encoding H7 Hemagglutinin
atgaatacccaaatccttgtattcgctctgatcgcaatcattccaaccaatgctgataaaatctgcttaggacaccacgctgtgagcaatggtacaaaggtcaatacactgacagagcggggcgtagaagtggtcaacgccaccgagacggtggaaaggaccaatatccctaggatttgctcgaagggcaagagaacagtagacctggggcaatgtggattgttggggactattacgggaccgccccagtgtgatcagtttctggagttcagcgctgatctcatcatcgagcgccgagagggatccgacgtgtgctacccaggaaaattcgttaacgaggaagcattaagacagattttacgtgaatcgggtggcattgataaagaagccatggggtttacttacagtggaattagaaccaatggagccacctcggcttgccggagatctgggtctagcttttacgcagaaatgaagtggctgctgtctaacacggataatgccgcgttcccgcagatgaccaaaagttataaaaataccagaaagagccctgcattaattgtctggggcattcaccactctgtttccacggccgaacagacaaaattgtatggaagcggaaacaagctggtcacagtcggatctagcaactaccagcagagctttgtgcccagtccaggggcccgccctcaggtcaatgggctttctgggagaattgattttcactggctgatgttgaaccccaacgacactgtgacctttagcttcaatggcgcgtttattgcgcccgacagagcctcctttttacgggggaaaagcatgggaatacaatctggtgtgcaggtggatgcaaattgcgaaggagactgctatcactccgggggtaccattattagcaatctcccattccagaacatcgactccagagccgttggtaaatgccccaggtatgtcaagcagcgtagtctcttgttggccacaggaatgaaaaacgtgcctgagatccccaaagggcgcggcctatttggggcaattgccggctttatcgagaacggatgggagggcctgatcgacggttggtatggctttcgccatcagaatgctcagggggaaggcacagctgcagactacaagagcacccagagcgccatcgatcaaatcaccggcaagctcaaccggatcatcgagaagacaaatcagcaatttgaattaatcgacaacgagttcaatgaggtagaaaagcagataggaaacgtgatcaactggaccagggatagcattactgaagtctggtcatacaatgccgaactcctggtggcaatggagaaccagcacactattgatcttgccgactctgagatggacaaactgtacgagcgcgtgaagcgacagctgagggaaaacgctgaggaagacggtactggctgctttgaaatcttccacaaatgcgacgacgattgcatggcatccatacggaacaacacttatgatcactcaaagtatcgggaggaagcaatgcagaatagaattcaaatcgatcccgttaaactgagctccggctacaaggatgtgattctctggtttagcttcggagcatcatgctttatcctcctagcaattgtaatgggtctggtgttcatatgcgtaaagaatggcaatatgcgctgtactatctgtatt

SEQ ID NO: 512 - DNA, 1680 bp, Influenza A virus
  misc_feature (1)..(1680): Codon Optimized Sequence Encoding H7 Hemagglutinin
atgaacacgcaaattctagtgtttgctctaattgccatcatacccacaaacgccgataaaatctgccttgggcatcacgcagtaagtaacggtaccaaggtgaacacgctcacagagcgcggggtcgaggtcgtgaatgccaccgaaacagtggaacgcactaacatccctcgaatctgttcaaaaggtaagcggactgtggatctgggacagtgtggcctgcttggtacgatcaccggtcctccccaatgcgatcagttcctggagttctcagcagacttaatcatcgagcgcagagagggtagcgatgtctgttaccccggaaagtttgtgaaggaagaagcccttcgccagattctcagagagtcaggaggcattgataaggaagccatggggtttacctacagcggtatccgtaccaacggagccacctctgcctgccgacgctcaggttctagcttctacgctgaaatgaaatggttactgagcaataccgataacgccgcattcccccagatgacaaaaagctacaagaatacccgcaaaagccctgcccttatagtttgggggatacatcactccgtgtccaccgcagaacagaccaagctgtacggcagcggcaacaaattggtgaccgtggggagtagtaattatcaacagagctttgtgccctcgcctggggccagacctcaggtcaatggacttagtggaaggattgatttccactggcttatgctcaatcctaatgataccgtcacattcagcttcaacggggcgttcatcgcacccgatcgcgcaagcttcctgcgtgggaagagtatgggcatccaatctggggttcaagtggatgcaaattgtgagggcgattgttaccacagcggcgggacgatcatctccaacctccccttccagaatattgattctcgtgccgttgggaaatgtcctagatatgtgaagcagcgttccctcctgctggctacaggcatgaagaacgttccggaaatccccaagggcagaggactgtttggcgccattgcaggatttattgagaatggatgggagggcctcatcgatggttggtacggattcagacaccagaacgctcagggggaaggaacagccgccgattataagtctacccagtcggctatcgaccaaatcaccggaaaactgaacaggctgatagagaaaactaaccagcagttcgagttgatcgacaacgagttcaacgaagtggagaaacagatcggcaacgtcattaactggacacgcgactcaattacagaggtgtggtcctacaacgctgagctgctggtagcaatggagaaccagcataccatcgacctggctgattctgaaatggataagctgtatgaacgggtcaagcgtcaactgcgcgaaaacgccgaagaggatggaacaggctgcttcgaaatttttcataaatgcgatgacgactgcatggcaagcatccggaacaacacatacgatcactcaaaataccgcgaggaggctatgcagaatcgcattcagattgatcctgtgaagttatcctccggctacaaagatgtcatcctctggttcagtttcggcgcgtcttgcttcatcctcctagcaatcgtgatgggtctcgttttcatctgtgtgaagaacgggaatatgagatgcactatttgcata

SEQ ID NO: 513 - DNA, 1680 bp, Influenza A virus
  misc_feature (1)..(1680): Codon Optimized Sequence Encoding H7 Hemagglutinin
atgaatacccagatccttgtgtttgctctgatcgccatcattcccacaaacgccgacaaaatttgcctcggtcaccatgctgtgtcaaacggtactaaagtcaacacattgacagagaggggcgtggaggtggtgaatgcaaccgagaccgttgagcgaacaaatatccctcgcatctgctccaagggcaagaaaactgtggatttgggccaatgtgggcttttgggaaccattactgggcctcctcagtgtgatcagttcctcgagttctctgccgacctgattattgaacgccgagaaggtagcgatgtctgttacccaggcaaattcgtcaacgaagaggcacttcgccagatactgagagagagtggaggcattgataaagaagctatggggtttacctattctgggataaggaccaacggggccaccagtgcttgtagacgtagtggcagcagcttctacgcggaaatgaaatggctcctgtcaaatacagacaatgctgcttttcctcagatgactaaatcgtacaaaaacacgcggaagagccccgccttaatcgtgtggggaatccaccactccgtgtccacagcggaacagaccaaactttacggctccgggaataagctagtgaccgtgggcagctccaactatcaacaaagtttcgtcccttcccccggtgcgagaccgcaggtcaacggacagtcagggaggatcgatttccactggctgatgttaaaccctaatgacactgtgactttctccttcaatggagcgttcattgcaccggatcgagcgtcttttctccggggaaagtctatgggtatccagtctggcgtgcaggtggatgccaattgcgagggagattgctaccactccgggggcactatcatctcgaatctccccttccagaacatcgacagccgggccgtgggtaaatgcccacggtatgtcaagcaaagatccttactgctcgccacagggatgaagaacgtgcctgagatccctaagggccgggggctgtttggagccatcgctgggttcattgaaaacggttgggaaggcctcattgacggatggtatggcttcaggcaccagaacgctcagggggaggggaccgccgccgactacaagagtacgcaatctgctatagatcagatcactggtaaactcaaccgcttgatcgagaaaaccaatcagcagttcgagcttattgacaacgagtttaacgaggtagagaagcagattggaaatgtcatcaattggactagagactctatcacagaggtgtggagctataatgccgaattgttggtggcaatggaaaaccagcacaccatcgacctggccgacagcgaaatggacaagttgtatgaacgcgttaaacgtcagttgagggagaacgccgaggaggacgggacgggttgctttgaaatctttcataagtgcgatgacgactgtatggcttctatccgcaataacacttatgaccacagtaagtaccgggaagaagctatgcaaaacagaatacagatcgacccagttaaattatcaagtggctataaagatgtgatcctctggttcagctttggagcctcctgtttcattttattggccatagtcatgggcctcgtatttatctgcgtgaaaaatggcaacatgcgctgcaccatctgcatt

SEQ ID NO: 514 - DNA, 1680 bp, Influenza A virus
  misc_feature (1)..(1680): Codon Optimized Sequence Encoding H7 Hemagglutinin
atgaacactcagatcctagtgtttgctctgatagcgatcatacccaccaatgcagacaaaatctgtctgggccatcatgcagtctctaatggaaccaaagtgaacaccctaactgagaggggcgtcgaggtggtgaatgcgaccgaaactgttgaaaggaccaatattcccagaatctgctcaaagggaaaaaaaacggtggacctggggcagtgtggattactaggcacgatcaccgggcctcctcagtgtgatcaatttctggagttcagcgcagatcttattattgagagaagagagggctctgacgtgtgctacccaggcaagttcgtgaacgaggaggctctgcggcagatcctacgtgagagcggaggcatagacaaggaggcaatgggatttacctatagcgggatacggacaaatggcgcaacgtccgcatgtcgccggagtgggtcttccttttacgcggagatgaagtggctgctgagcaacaccgacaatgccgcgtttcctcagatgacaaaatcatataagaacacccgaaagtccccagcactcattgtttgggggatccaccacagtgtaagcaccgccgagcagactaaactatacggcagcggaaataaacttgtcaccgtcggctcctccaattaccaacagtccttcgtcccttcaccgggtgccaggccccaggtgaacggacaatccgggcgtattgactttcactggctgatgttgaatccaaacgacaccgtgacgttttcgttcaacggcgcatttattgcccccgatcgggcgagcttcctgcggggaaaatccatgggcatccagagtggggtccaagtggacgcaaactgtgagggcgactgctaccactccggtggaacaatcattagcaatcttccctttcagaacattgactctcgggccgtaggcaagtgtccgcgctacgtgaaacagcgctctctgctattggctacaggcatgaagaatgtaccagagatacctaagggacgaggcctctttggggccatcgccggcttcatcgagaatgggtgggaaggcctgattgacggttggtatggctttcgccaccagaatgcacagggtgagggaacggcagccgattacaagtccacgcagagtgccatcgatcagattaccggtaaattaaaccggctcattgagaaaactaaccagcagttcgaactgatcgataatgagtttaatgaggtggagaagcaaattggcaacgtgattaattggaccagggacagtataacggaagtgtggtcctataatgcagaattgctggtggccatggaaaaccagcacacgatcgatctagctgattctgagatggacaaactgtatgagcgtgttaagcgacagcttcgcgaaaatgcagaggaagatggcacaggctgctttgagatattccacaaatgcgacgatgactgtatggcttcaatacgtaataatacatacgaccactcaaaataccgtgaagaggccatgcaaaatcgcatccagatcgatcctgtgaaactatcatcaggctataaagacgtaattctttggttttctttcggcgcaagttgcttcattcttctcgccattgtgatgggacttgtcttcatatgtgtgaaaaacggaaatatgcgctgcaccatctgtatc

SEQ ID NO: 515 - DNA, 1680 bp, Influenza A virus
  misc_feature (1)..(1680): Codon Optimized Sequence Encoding H7 Hemagglutinin
atgaacactcaaattctagtcttcgccctgatcgcaatcatccctactaatgccgacaagatctgtctgggacaccacgcagtttcaaacgggacaaaggtgaacaccctgaccgagcggggggtagaagtggttaacgcaactgagaccgtggaacgtaccaatatacccaggatatgtagcaagggtaaaaagactgtcgatctcggtcagtgtggactcctgggaaccatcaccggacctccccagtgtgatcagttcctggagttcagcgcagatttaatcatcgaacgtcgcgaaggatccgacgtctgctatccgggtaagtttgtaaacgaggaggctctgagacaaatcctcagagaaagtgggggcatagacaaggaggcaatggggttcacttattctgggattaggacaaatggcgccactagcgcttgccgccgaagtggcagttccttctacgccgagatgaagtggttgcttagcaatactgataatgctgctttcccccagatgacgaagtcttacaaaaatactcgtaagagccccgcgctgatcgtgtgggggatccaccacagtgtgagcactgccgagcaaaccaagctgtatgggtctgggaataaattagtgaccgtgggctctagtaactaccagcagtcattcgttccaagtcccggcgcacggcctcaggttaatggccagtctggccggattgactttcattggctcatgctgaatcccaatgacacggtgacattctcctttaacggagcatttatcgcaccagacagggcttccttccttcgcggaaaatccatgggaattcagagcggggtccaggtcgatgctaattgtgaaggggattgttaccactctggaggcacaattattagcaatctgcccttccaaaacatcgactcccgtgctgtgggcaaatgtccacgctacgtcaagcagagatcattacttcttgctacaggtatgaaaaacgtgccggaaatccctaaggggagaggacttttcggtgccatagctggattcatagagaacggatgggaagggctcattgacggctggtatggcttcagacatcagaacgctcagggagagggaactgctgctgactacaagagtacccagtcagctatcgaccagattactgggaaattgaaccgcctgattgaaaagactaaccagcagttcgagctcatcgacaatgaattcaatgaagtggagaagcagatcggtaatgtcatcaattggactcgggattcaattacagaggtgtggtcttacaatgcagagctgctggttgccatggaaaaccagcataccattgacctggcagacagtgaaatggataaactgtacgagagggttaaacggcaattgcgcgaaaatgccgaggaagacgggacaggatgttttgagatctttcataaatgcgatgacgactgtatggcttcgattcgaaacaatacttacgaccactcaaagtatagagaagaagcaatgcagaaccggattcaaatcgaccctgttaagctgtcatccggctataaggatgtaattctctggttcagctttggtgcatcatgttttatactcctcgccatcgtgatgggccttgtattcatctgcgtcaagaacgggaatatgagatgcaccatttgtatt

SEQ ID NO: 516 - DNA, 1680 bp, Influenza A virus
  misc_feature (1)..(1680): Codon Optimized Sequence Encoding H7 Hemagglutinin
atgaacacacagatcctcgtttttgccttgatcgcaatcatcccaacaaacgcagacaaaatctgtctgggtcaccacgccgtcagtaacgggactaaggtgaacaccctcacggagcggggagtcgaggtcgtgaatgctactgagaccgtggagcgtaccaacatccccaggatttgcagcaaaggaaagcggaccgtagacctcgggcaatgtgggctgttaggcacaatcactggccctccccagtgtgaccagtttcttgagttctctgctgacttaatcatcgagcgtcgagaagggtcagatgtctgctatcctggcaaatttgtgaatgaggaagcacttcggcagattttgagagaatcgggcggcatcgataaggaggctatgggcttcacctactctgggattaggaccaatggggccaccagtgcctgtaggcgctcaggcagttccttttacgctgagatgaagtggctactgagtaatacggataacgccgccttccctcagatgactaagagctacaagaacaccagaaaatctcctgccttgatagtgtggggaatacaccacagcgtatccaccgcagaacaaaccaagttgtatgggagcggaaacaagttggtcaccgttggatcatcgaattaccagcagagctttgtgccttctcccggcgctcggccccaggtgaacgggctgagtggtcgtatcgacttccattggcttatgcttaacccgaatgacaccgtaacgttcagcttcaatggcgcttttattgcacccgaccgcgcgtcattcctacgcggaaagtccatggggatccagtctggtgtgcaggtggacgccaattgtgagggcgattgctatcactccggagggacaattatctcgaatctcccgttccagaacattgacagccgggctgtcgggaagtgcccgcgctatgtgaaacagaggtccctccttcttgcaactggcatgaaaaacgttcccgagatcccaaagggccgtggactgtttggagccatcgctggcttcatagagaacggctgggagggcctgattaatggttggtacggctttagacaccaaaatgcccagggagaaggcaccgccgcagactacaaatcgactcagtccgcaattgatcagattaccgggaaactcaaccggctcatcgaaaagactaaccagcagtttgaattgattgacaacgagttcaatgaggtggagaagcagatcgggaatgtcatcaactggacacgggactcaataaccgaagtgtggtcatacaatgcggagctgcttgtcgccatggaaaatcagcacacaatcgacctagcagactctgaaatggacaagctgtatgagagagtgaagcgacaattacgtgaaaatgcggaggaggacggaactggctgcttcgagatcttccacaagtgtgatgacgattgcatggcctctatccgcaacaacacttacgatcatagcaaatacagggaggaagccatgcagaaccggatccagattgatcctgtgaagctgtctagtggctataaagacgtaatcctctggttcagcttcggcgcaagctgcttcatccttctcgccatagtgatgggcttagtgtttatatgcgtgaagaacgggaacatgcgctgtaccatttgtatc

SEQ ID NO: 517 - DNA, 1680 bp, Influenza A virus
  misc_feature (1)..(1680): Codon Optimized Sequence Encoding H7 Hemagglutinin
atgaatactcaaatcctcgtctttgcactcatagcaattatccctaccaacgctgataagatttgtttggggcatcacgccgtctccaacgggactaaggtaaatacattgacggaaagaggggtggaagttgtgaatgccactgagactgtggagcggaccaacatcccccgtatatgttcaaaaggaaaacgcacagtcgacttgggtcagtgcggactcctggggactattaccgggccacctcagtgcgaccaatttctggaattcagcgcggacctgatcattgagcgccgagagggaagtgacgtatgctaccctgggaagtttgttaatgaggaagcactaaggcaaatactgcgggaatcgggcggaattgataaggaagctatgggcttcacgtacagcggaattagaaccaacggggctacgagtgcgtgtagacggtccggtagttccttttacgccgaaatgaaatggctcctaagcaatacggacaacgccgcatttcctcagatcacaaaatcatacaagaacactaggaagagtcccgcccttattgtgtggggaattcatcacagtgtgagtactgccgaacagactaagctctatggctcaggaaataagctcgtcaccgttgggtccagtaactatcagcagtcttttgtcccgtcacctggggccagacctcaagtcaacggcttgagtggacgtatcgattttcattggctgatgctgaacccaaatgacactgtcacttttagcttcaatggggcttttatcgctccagatcgggcatccttcctgcgtgggaaatccatgggaattcaatcaggtgtccaggtggatgctaattgcgagggggactgctatcactcaggggggactattatatccaatctgccctttcagaacatcgattccagggcggtgggcaaatgtcctagatatgtaaaacagaggtctctgcttctggcgacaggcatgaagaatgttcctgaaatccccaagggcaggggcctgttcggggccattgcaggctttatcgagaacggctgggaggggctaatcgacggctggtacggctttcgacatcagaacgctcagggtgaaggcacggctgccgattataagtcgacgcagtcagccattgatcaaatcactggcaaacttaatcgcctcatagagaagaccaatcagcagtttgaactcatcgataacgagttcaacgaggtggaaaaacaaattggtaacgtcatcaattggaccagggacagtattacagaggtttggtcctacaacgccgaattgttggtggcaatggaaaatcagcatactatcgacctggctgacagcgaaatggacaagctctatgaacgggtaaagaggcagttacgggagaacgctgaggaggacggcactgggtgtttcgagatctttcataaatgcgatgatgactgcatggcttctatccgtaataacacgtatgatcactccaagtatcgggaagaggccatgcagaaccggatccaaatcgatcccgtaaagttgtcatccggctacaaagacgtaattttgtggttttctttcggagcttcctgtttcatactgctagctatcgtaatggggttggtgttcatctgcgtgaagaatggaaacatgaggtgtaccatctgtatc

SEQ ID NO: 518 - DNA, 1680 bp, Influenza A virus
  misc_feature (1)..(1680): Codon Optimized Sequence Encoding H7 Hemagglutinin
atgaacacccagatcctcgtcttcgctctaatcgccataatccccactaatgccgacaaaatttgtctcggacaccacgccgttagcaacgggacaaaagttaacacacttactgagagaggggtcgaggttgtaaatgctacagaaaccgtggagaggactaatattccaagaatttgttcaaagggaaaaaagacagtggatcttggccagtgcgggctgctggggacaatcacaggaccaccccagtgcgaccaatttctggaattctctgcagacctgattattgaacgccgtgaggggagtgacgtttgctatcccgggaagtttgttaacgaagaggctcttagacaaatcctccgcgaatctggggggatcgataaagaggccatggggtttacctactccggcattaggactaatggagctacctccgcctgtaggaggtctggaagctcattttacgcagaaatgaaatggttgctcagcaacaccgacaatgcagcgtttccgcaaatgaccaagagttacaagaacacccgaaagtctcctgcgttgattgtgtggggcattcaccattcagtttccactgcagagcagacaaaactgtacggttcaggaaacaagctggtaaccgtgggatcttccaactatcagcagagcttcgtgccctcgcccggagcccgccctcaggtgaacggacagagtggaaggatcgacttccactggctgatgttgaatcccaacgataccgtgactttctctttcaacggtgcatttatagcccctgaccgcgcttcctttctccgaggaaaaagcatgggcatccagtctggagtgcaggttgacgcaaattgcgaaggcgactgttaccatagtggcggcacaataatttctaaccttccctttcaaaatattgacagccgcgcagtaggtaagtgtcctagatacgtgaagcagaggagcctactgctcgccactggcatgaaaaatgtgccggagatccctaagggcagagggctgttcggcgccatcgccggcttcatcgaaaatggatgggaggggttgatagacggttggtacggcttccggcatcagaacgcccagggtgaggggaccgccgctgattataaaagtacccagtctgctatcgatcagatcaccgggaagctcaaccgtcttattgagaagaccaatcagcaattcgaactcatcgacaacgagtttaacgaggttgaaaagcaaattggaaatgtgattaattggacacgggattcaataaccgaagtctggtcgtacaacgcagagctacttgtggcaatggagaaccagcacaccatagaccttgccgactccgaaatggataagttgtatgaaagagtgaaacgccagctgcgggagaatgccgaggaagatgggacaggatgttttgagatctttcacaagtgcgacgatgattgcatggcctccattcgaaacaatacttatgaccatagcaaatacagagaggaggccatgcagaaccggattcaaatcgatcctgttaagttatcttcaggttacaaggatgtcatcctttggttctcgtttggagccagctgcttcatattgctggctatcgtgatgggtctggtgtttatctgcgttaagaacggcaatatgagatgtacgatctgtatt

SEQ ID NO: 519 - DNA, 1680 bp, Influenza A virus
  misc_feature (1)..(1680): Codon Optimized Sequence Encoding H7 Hemagglutinin
atgaacactcagattctggtctttgccctgattgctatcatcccaaccaacgcagacaagatctgtctgggacaccatgccgtatctaacggaaccaaggttaacacgttgaccgagcgcggcgttgaagtcgtcaatgccactgagaccgtggagcgaacaaacattcccagaatctgtagcaagggcaaacggactgtggacctgggccagtgtgggttgttgggaacaatcacaggacctccacagtgtgatcagttcctggagtttagtgcagaccttatcatcgaacgcagagaaggttccgacgtctgttaccctgggaaatttgtaaatgaggaggccttgagacagatccttagggaatctggaggaatcgacaaggaggccatgggctttacctatagcggaataaggaccaatggcgccacttccgcctgtaggagaagcggttcatcattctatgcagagatgaagtggttgttaagtaacacggataatgctgcgtttccacagatgaccaagtcctacaagaatacccgaaaatcccccgcactcattgtctggggaatacaccacagcgtctcaacagctgagcaaacaaaactctatggatccgggaataagctcgtgaccgtaggctcatcaaactaccagcagtcgttcgtgccatctccaggggcccggcctcaggtcaacggtctgtcaggacgcattgattttcactggctgatgcttaatcccaacgataccgtcacattctccttcaatggggcgtttattgcgcctgacagagctagctttttgcgaggtaagtctatgggcatacagtctggggtgcaagtggacgcgaattgcgagggggactgctatcattccggaggcaccatcatctccaacctcccatttcaaaatatcgacagtagggcggtggggaagtgcccccgttacgtaaaacagcgctccctcctgctggccacagggatgaagaatgttccagaaataccaaaaggaaggggtctgtttggtgccatcgcaggcttcatcgaaaacggatgggaggggctgattgatggttggtacggatttagacaccagaatgcccagggcgaaggaactgccgctgattataagagcacacagtcagctatagaccagatcactgggaagctaaacagaatcattgaaaagacgaaccagcagttcgaactaatcgacaatgagttcaacgaggtggaaaagcagattgggaacgtgataaattggacacgcgactccataacggaagtgtggagctacaatgcggagctgctggtggctatggagaatcagcacaccatcgaccttgcggatagtgaaatggataaactctacgagcgtgttaagcggcaattgcgggagaacgccgaggaggatgggaccgggtgcttcgagattttccacaaatgtgatgatgactgtatggcctccatacgcaataatacctacgaccatagcaaatatcgggaggaagccatgcagaaccgaatccaaatagacccagtgaagctgagttccggctataaagatgtgattctctggtttagctttggagcaagctgttttatcctgttagcgattgtgatgggtttagtgttcatttgtgtgaaaaacggtaacatgcgatgcaccatttgtatc

SEQ ID NO: 520 - DNA, 1680 bp, Influenza A virus
  misc_feature (1)..(1680): Codon Optimized Sequence Encoding H7 Hemagglutinin
atgaatacccagatccttgtctttgccctgatagccattattcccaccaacgcagataaaatttgcctcgggcaccacgctgtgagcaacggcacaaaggtgaatactctgacagaacggggtgtagaggtggttaatgcaacagagacagtggagcgcacaaacatccccagaatctgctctaagggcaagcggactgtggatttagggcaatgtggactgctaggtactatcaccgggcctccacagtgtgaccagtttttggagttctctgccgatcttatcatcgagcgtcgagaggggagtgatgtgtgctacccaggcaaatttgtgaacgaggaagcccttcggcagatcctgagagagtccggcggcatcgacaaagaggccatgggttttacctattcaggaatccgaaccaacggagccacctccgcctgtaggcggagtgggtctagcttttatgcagaaatgaaatggttgctgtccaacaccgataatgcagctttcccacagataacaaagtcttacaaaaatacgcgcaagtccccagcgctaattgtgtggggcattcatcacagcgtgtctactgcggagcagaccaagctgtacgggagcgggaataaattggtcacagtcgggagctcgaactaccagcaaagcttcgttcctagccccggggcaaggcctcaggtgaacggactgagcggcagaattgacttccactggttgatgcttaatcctaacgatacagtgacctttagcttcaatggagcgttcattgcccctgatcgcgcctcctttctccgggggaaaagtatggggattcaatccggggtgcaggttgacgctaattgtgagggtgattgctaccactccgggggcaccattataagcaatttaccgtttcagaatattgactctcgagccgtggggaaatgtccccggtacgtcaagcaaaggtctttgctgctggctaccggcatgaaaaacgtacccgagatcccaaaaggacgcggcctcttcggtgcaatcgccggctttatagagaatggatgggaagggcttattgacgggtggtatgggttccgccatcagaatgcgcaaggcgaaggaactgccgccgattacaagagtacacagtccgccatcgatcaaattactggcaaactaaatagactcatcgagaagacaaaccagcagtttgaactcattgacaacgaattcaacgaggtagagaaacagattggcaacgtcatcaattggacacgggacagtatcacagaagtctggtcctacaacgcagagcttctcgttgctatggaaaatcagcacaccattgacctggctgactccgagatggacaagttgtatgagcgtgtgaaaaggcagttgcgtgaaaacgccgaggaagacggcacaggttgttttgagatctttcacaaatgcgacgacgattgtatggcaagcataagaaacaatacttatgaccacagtaaatatcgagaggaagccatgcagaacagaatccaaatcgaccctgtgaaactaagctcaggctacaaggacgtgatcctctggttctcctttggtgcttcctgctttattctccttgccatcgtcatgggcctcgtgttcatctgcgttaagaacggtaatatgcggtgtactatttgtatc

SEQ ID NO: 521 - DNA, 1680 bp, Influenza A virus
  misc_feature (1)..(1680): Codon Optimized Sequence Encoding H7 Hemagglutinin
atgaatacccagattctcgtttttgccctaatagctatcattcctacaaatgccgataaaatttgcttgggccatcatgccgtgagcaacgggactaaggttaacaccctgactgagcggggcgtagaggtggttaacgccacagagacagtggaacggacgaacattccaagaatttgttcaaagggcaagaaaacggtggacctcgggcaatgtggtctgctaggcactataacaggacctcctcagtgcgatcagtttctggaattcagtgcagatctgatcatcgagcgtcgagagggatcagatgtctgttatcctgggaagttcgtcaatgaggaggcactgagacagatactcagagagagcggaggcattgataaggaagctatgggttttacctattctggtattagaactaacggagccacaagtgcctgtcgtcggtcgggctcttcgttttacgctgagatgaagtggctgctgagtaatactgacaatgcagcgttcccccagatgactaagagttataaaaacacccgtaaaagcccagcactgatcgtgtggggaattcatcattcagtctctacagccgagcagaccaagctctacgggtctggcaacaagctcgttacagtaggatctagcaactatcaacagagctttgtaccatcccctggagctcgtccacaagtgaacggtcagtcgggccgtatcgactttcactggctgatgctgaatcctaatgacacggtgactttcagtttcaatggagccttcatcgcaccagaccgcgcaagctttctacgcgggaagagtatggggattcagtccggcgttcaagtggacgccaattgcgaaggggactgttaccatagcggcggcaccatcattagtaacctcccatttcaaaacatcgattctcgcgccgtggggaaatgtcctagatacgtgaaacagcgcagcctgctcctcgcaactggcatgaagaatgttccagagattccgaaggggcggggtctctttggcgccatcgccgggttcatcgaaaacgggtgggagggactgatcgatggctggtatggcttccgacatcaaaacgcacagggtgagggcacagctgccgattataaatccacgcagagcgcaatcgatcagatcaccggcaaactgaacaggctgatcgagaaaactaatcagcagttcgagcttatcgataatgaattcaatgaagtggagaagcagattgggaatgtgattaattggactcgggactctattactgaagtgtggagttacaacgccgagctcttggttgctatggagaatcagcatacaattgacttggcagattccgagatggataagctctacgagcgtgtcaagcggcaactgagagagaacgccgaagaggatgggacggggtgcttcgagattttccataagtgcgacgatgattgtatggccagtatcagaaataatacatatgaccatagcaaatacagagaggaagcaatgcagaaccggatccagattgatccggtgaagctctctagcggatataaggatgttatcctgtggttttcttttggagcctcctgtttcattctgctggccattgtaatgggactagtcttcatatgtgtaaaaaacggcaatatgaggtgcactatttgtatt

SEQ ID NO: 522 - DNA, 1680 bp, Influenza A virus
  misc_feature (1)..(1680): Codon Optimized Sequence Encoding H7 Hemagglutinin
atgaacacacagatcctggtattcgcgctcatcgcaattataccaacaaatgccgataagatatgcttgggacatcacgccgtatccaacggtaccaaagtgaatacactgaccgaacgtggcgtagaggtggtgaacgccactgagacggttgagcgcaccaacatcccccgcatctgctccaagggaaaacgcaccgtcgacctgggacagtgtgggctgctcggcacaatcacgggtcctcctcagtgtgaccaattcttggagttcagcgcagatctaattatagagaggcgggagggaagcgatgtgtgctatcctggcaaatttgtcaacgaggaagcccttcgccagattcttcgggagtccggcggaatcgataaagaggctatggggtttacatatagtggaatccgcaccaatggcgccacgtcggcctgtaggaggagcggatccagtttctatgccgagatgaaatggctcctcagtaatactgataatgctgcgttcccccagataaccaaatcgtacaaaaatacacggaagtctcccgcgctgattgtatggggcatacaccactccgtatcgactgccgaacagactaagctctacggctctgggaacaagttagtgaccgtcggctcgagcaattaccagcagagttttgtcccatcaccaggggcaagacctcaggtgaacgggctttcagggaggattgacttccactggctgatgctgaacccaaatgacactgtcaccttttcgttcaacggggcatttatcgccccagacagggcctcattccttagaggcaaatctatgggcattcaaagcggggttcaggtggacgcgaactgtgagggcgactgttatcatagcggtggcactattatctccaacctgccctttcagaatatagacagtagagccgtgggtaagtgcccacggtatgtgaagcaaaggtccctgctcctcgctacggggatgaagaatgtgccagagattcctaagggtcgcggcctgttcggagcaatagcgggttttatagaaaatggttgggaaggattaatagatgggtggtacgggtttaggcaccagaatgctcagggagagggtacggcagctgattataagtctacacaatctgccatcgaccagatcaccggaaagctcaacagacttatcgaaaaaactaaccagcagttcgaattgatcgacaatgaatttaatgaagtggagaagcagataggtaacgtgattaactggactcgggactcaatcactgaagtttggagttacaacgcagagctcctggtcgccatggagaaccagcataccatagatctcgctgacagtgagatggacaaactgtacgaaagagtgaagcgtcagctcagagagaatgcggaggaagatgggaccggatgcttcgaaatttttcacaagtgtgacgacgactgtatggccagcataaggaataacacttatgatcattctaagtatcgtgaggaggcaatgcagaacaggattcaaattgatccggttaagctttcttcaggatacaaggacgtcattctgtggttctccttcggggcatcttgctttattttacttgcaatcgtgatggggttagtctttatctgcgtgaaaaatgggaacatgaggtgtactatctgcatc

SEQ ID NO: 523 - DNA, 1680 bp, Influenza A virus
  misc_feature (1)..(1680): Codon Optimized Sequence Encoding H7 Hemagglutinin
atgaatacacagatcctggtctttgctctgatcgcaattattcctacgaatgcagacaagatttgccttggacaccacgccgtatctaacggcaccaaagtcaataccctgaccgagcggggcgttgaagttgttaatgccaccgaaacagtagaacgcactaatataccacgcatttgctcgaaagggaaaaagaccgttgacctcggccagtgcggcctgcttggcacaatcacaggaccaccacagtgtgaccaatttctcgaattttccgctgatctgataatagagaggcgggaagggagcgacgtgtgttatccagggaagttcgttaacgaggaagcacttaggcaaatactgcgggaaagcggtggcatcgataaagaggccatgggctttacctacagtggtattaggacaaacggcgcgacatccgcgtgtaggagaagcggctcatccttctacgctgaaatgaagtggctgttaagtaataccgataatgcggctttcccgcaaatgactaagagttacaaaaacactagaaagtctccagctctgattgtttgggggattcatcattctgtgagtacagccgaacagaccaagttgtacggctccggaaacaagctggtgactgtaggctcttctaattatcaacagtcttttgtacctagtccgggtgcccgcccacaggtaaacgggcagtcaggcagaatcgatttccactggctcatgctgaatccaaacgataccgtcaccttcagtttcaatggagcatttatagcaccggaccgcgcgtcattcctacggggtaaatccatgggcattcagagcggggttcaagtagatgccaactgtgagggcgactgctatcactctggcggtacgatcataagcaaccttccgtttcaaaatatcgacagccgtgctgttggcaaatgcccccgttacgtgaagcagagaagccttctgttggctactggaatgaagaatgtgcccgagattcctaagggaagaggcctcttcggagcgatcgctggatttatagaaaatggctgggaaggactaatcgacggctggtatgggtttagacaccagaacgcacagggggagggcactgctgcggattataagtcgacacagtccgcgatcgaccagatcaccggtaaactcaatcggctcattgagaagacaaaccaacagttcgagttgatcgataatgaatttaatgaagtggaaaagcagataggaaatgtgatcaactggacacgggacagcattaccgaagtatggagttacaatgcagagctgctggttgctatggagaaccagcacacgattgatttggccgattcggaaatggacaagctttacgagcgggtgaaaaggcaactccgcgaaaatgctgaagaggatgggactggctgtttcgagatttttcacaagtgcgacgacgattgcatggccagcataaggaataatacatatgaccactccaaatacagggaagaagcaatgcagaacagaatccagatcgaccctgtgaagttgagtagtggatacaaggatgtcatcctgtggttttcttttggcgcctcatgcttcattctgctggcaattgtaatgggcctggtgttcatttgtgtgaaaaacggaaatatgaggtgtacaatctgtatc

SEQ ID NO: 524 - DNA, 1680 bp, Influenza A virus
  misc_feature (1)..(1680): Codon Optimized Sequence Encoding H7 Hemagglutinin
atgaacacgcaaattttggtcttcgcattgattgcaattattcctacgaacgcagacaagatctgtctaggacaccacgctgtgtcaaacggaacaaaagtgaacacgctgaccgagcggggggtcgaagtggtgaatgcaactgaaactgtagaacgaactaacatcccaagaatttgtagcaaaggaaagaagacagttgacctgggtcagtgcggactgctcggtaccatcaccggtccgccgcagtgcgaccaatttttagagttctctgcagacttaatcatcgagcgcagagagggctcagatgtctgctaccccggtaagttcgtgaacgaggaggcgcttcgtcagattctgcgaaagagtggcgggatcgacaaggaggctatgggcttcacttactcaggcattcgtacgaatggcgccacatccacctgcaggcggagcgggtctagtttttacgccgagatgaagtggttgttatcgaacaccgacaatgcggccttcccccagatgacaaaatcatacaaaaatacgcgcaagtcacccgctataattgtgtggggcattcaccacagcgtctctacggccgaacagacgaaattatacgggtctgggaacaaactggtgacagtcggcagcagtaactaccagcaatctttcgtgccatcgccaggagcccgcccgcaggtcaatgggttatctggacggatagacttccattggctgatgcttaacccaaacgacactgttacctttagcttcaatggggcttttatcgcgcctgatagagcttgcttcctgagaggaaagtcaatgggaatccagtcaggtgtgcaggtggacgcggattgtgaaggtgattgctaccacagtggggggacaatcattagtaatctgccattccagaatattgattcacgtgcagtaggaaaatgtccacgatatgttaagcaaaggtcgttgctactcgctactggtatgaaaaacgtaccagaaatacctaagggaaggggactatttggtgcaattgcagggttcatcgagaacggctgggagggcctcatagacggatggtatggtttccggcaccagaacgcacagggcgaaggcacagcagccgattacaagtccacacagagcgcaatcgaccagatcacaggcaaactcaataggctcatagaaaagaccaatcagcagtttgagctcattgacaacgaattcaatgaagtggagcggcagataggaaacgtgataaattggacccgggatagcattacggaggtctggtcctataacgcggagctgctggtggccatggagaatcagcacaccattgacctggccgatagcgaaatggataagctgtatgagcgcgtgaagaggcagctgcgggagaacgctgaagaggacggcacgggctgttttgagattttccacaagtgtgatgacgactgcatggcctccatccgaaacaacacctatgaccattccaaataccgggaagaggcaatgcaaaatagaatacagatcgatcctgtgaagctgtccagcggctataaagacgttattctgtggttctctttcggggcatcctgttttatactcttagctatcgttatgggcctggtctttatttgcgtgaagaacggcaacatgcggtgcacgatttgcatc

SEQ ID NO: 525 - DNA, 1680 bp, Influenza A virus
  misc_feature (1)..(1680): Codon Optimized Sequence Encoding H7 Hemagglutinin
atgaacacccagatcctggttttcgctttaatcgcgattatacccacaaacgctgataagatctgccttgggcatcatgccgtgagtaatggtacaaaggtcaatacactcactgagagaggcgtcgaggtcgtgaatgctactgaaaccgtcgagagaacaaatatacccaggatttgcagtaaaggcaagaaaacagtagatctcggtcagtgcgggttgctcgggaccatcactgggccacctcagtgcgaccaattcttggagttttccgccgacctcattattgagcgccgggaaggcagtgacgtctgttaccccgggaaattcgttaatgaggaggccctgagacagatcctccgggagagcgggggaattgacaaggaggccatggggttcacctattctggaattaggactaacggcgccacatccgcgtgtcgccggtctgggtcatctttctacgccgagatgaaatggttgctcagcaataccgataacgccgcctttcctcagatgaccaagtcatacaaaaacacacgaaagtcacccgcactgatagtgtggggcatacaccacagcgtttcaactgccgaacagacaaaattgtacggatctggcaataagctggtcaccgtgggctccagtaactaccagcaaagcttcgtcccctcccccggtgctaggccacaagtcaatggccagtccggtagaatcgacttccattggctaatgctaaaccccaatgacactgtgacattttcttttaacggagcattcatcgccccggatagggccagctttctcaggggcaaatcaatggggattcagagtggggtgcaagttgatgctaattgtgagggtgattgctatcattcagggggaaccattatcagcaatttgcccttccagaacatagactcacgcgccgtcggtaagtgccctcgctatgtcaagcaaaggtccctgctgctggccactggaatgaagaacgtgcccgagatcccaaagggcaggggcttattcggggccattgcaggtttcatcgaaaacggctgggaaggactaatagatgggtggtacggctttcgtcaccagaacgcacaaggggaggggacagctgctgattataaaagtactcagagcgctatcgaccagattacaggtaagctgaatcggttaatcgagaagaccaaccagcagttcgaacttattgacaatgagttcaatgaggtggagaagcagattggcaatgtgattaattggacgcgggatagtattaccgaggtctggtcctataacgccgagttgctagtggcaatggaaaaccagcacacgatagatcttgcagacagcgaaatggataagttgtacgaaagggtgaaacggcaactaagggaaaacgctgaggaagatgggacaggatgcttcgagatcttccacaaatgtgacgatgactgtatggccagtattagaaataacacatatgaccattccaaatatcgggaagaggctatgcaaaatcgcatccagattgatcccgtaaaactctcctcgggatacaaagacgtgatcctgtggttctccttcggagcctcttgtttcatcctactcgccatcgttatggggttagtgttcatctgtgtgaagaatggcaatatgaggtgtacaatctgcatt

SEQ ID NO: 526 - DNA, 1680 bp, Influenza A virus
  misc_feature (1)..(1680): Codon Optimized Sequence Encoding H7 Hemagglutinin
atgaatacccagatccttgttttcgccctcatcgccataattcccaccaacgcagataaaatctgtctcggccaccacgcagtgagcaatggcactaaggtcaataccctcactgaacgaggtgtcgaggttgtcaacgccactgaaacggtagagagaacgaacatcccccgcatatgcagtaaaggcaagaaaactgtggatctcggacagtgcggcctgctgggcaccattaccggcccgccccagtgcgatcaattcctggaattttctgcagacctcatcatcgaacgtcgggaagggagtgacgtgtgttaccccgggaaattcgtaaatgaggaggctcttcgccagattctgagggaaagtgggggtattgataaggaagcaatgggctttacctattccggaattagaaccaatggcgccacctccgcatgtagacggtctggttcatcattctacgctgagatgaagtggctgctgtccaacactgacaacgctgcatttcctcagatgactaaaagttacaaaaacactcgcaaatcccctgcccttattgtttggggcattcatcatagtgtaagtacagccgaacaaaccaaactgtatggctcagggaataaattagttaccgtgggttcatccaactaccagcagtctttcgtcccttctccaggcgctcgcccacaagttaatgggcaatctgggcgaatcgatttccactggttgatgctgaaccccaacgacaccgttaccttcagttttaacggcgcatttattgcccccgaccgcgcaagttttctgaggggcaaatcaatggggatccaatctggcgtccaggtggatgccaactgcgaaggcgactgttatcattccggtggaacaataatctctaatttgccgtttcagaacattgattcaagagccgtgggcaagtgcccacggtacgtaaaacagcgctccttactccttgctacagggatgaagaacgtgccggagatccctaaaggccgaggactctttggtgctattgcagggtttatagaaaatggctgggagggactgattgatgggtggtacggattccgacaccagaatgcccaaggcgagggtaccgctgcagactacaaaagtacccagagtgctatcgaccagatcaccgggaagttaaatcgtttgatagaaaaaacaaatcaacaattcgagctgattgacaatgagttcaacgaggtggagaaacaaataggaaacgtaatcaattggactcgtgacagtataaccgaagtctggagctacaatgcggagctactcgtcgctatggaaaatcagcatacaatcgatctggcggacagcgagatggataagctgtacgaacgcgtgaagagacaactgagagaaaacgccgaggaagatggcacaggctgcttcgagattttccataagtgcgatgacgattgcatggcgagtattaggaataacacatatgatcactcaaagtatcgcgaggaggcgatgcaaaacaggatccagattgaccccgtgaaattgtcttctggctacaaggacgtgatactctggttttccttcggggcctcctgtttcattctgctggcgattgtgatggggctggtgtttatatgtgtgaaaaatgggaatatgagatgtactatttgcatt

SEQ ID NO: 527 - DNA, 1680 bp, Influenza A virus
  misc_feature (1)..(1680): Codon Optimized Sequence Encoding H7 Hemagglutinin
atgaacacccagatccttgtgttcgcactgatagcgattataccaaccaacgccgacaagatctgcttagggcaccacgctgtaagtaatggtactaaggtgaatacgctgactgaaagaggtgtggaagtggtgaacgccacagaaaccgtagaaaggaccaacatccccagaatctgcagcaaggggaagcggaccgtagacctgggacaatgtggacttctgggaacaattactggccctccacagtgcgaccagttcttggagtttagcgccgacctcattatcgagcgacgggaaggcagcgatgtatgttatccaggcaaatttgtgaacgaagaagctctcaggcagattctgcgggaatccggcggcattgataaagaggctatgggctttacctacagcgggatccgtacaaacggggcaacctctgcctgtcggagatctggctcaagcttttatgccgagatgaaatggctcctgtctaatactgacaatgctgctttcccacagatgacgaagtcctataaaaacacccggaagtcccccgccttaattgtatggggcatccatcattccgttagcacagccgaacagaccaagctttatggatctggaaacaagctggtgaccgtgggctcaagtaactatcaacagtcattcgtgccttcacctggagcccgcccgcaggtcaatggccttagcggacggattgactttcattggcttatgctgaatcccaatgatacagtgacgttcagcttcaacggcgccttcatagcccccgaccgtgccagttttcttcggggaaagagcatggggatccaaagtggcgtgcaggtggacgccaattgcgaaggcgattgctatcattcaggcggaacaattatcagtaacctgccgtttcagaatattgacagtcgagcagttgggaagtgtccaaggtacgtgaaacagcgcagcctccttttagccacaggcatgaagaatgtcccagagattccgaagggccgtgggctgtttggtgctattgcaggttttatcgaaaatggctgggaaggacttattgacggctggtatgggtttaggcatcagaatgcccagggtgaaggcactgccgccgactataagagcacgcaaagcgcgatcgatcagattactggcaagttaaatagactgatcgaaaaaaccaaccaacagtttgagttgattgataacgagtttaatgaggtcgaaaagcagattgggaacgtgataaactggacccgggacagcataaccgaagtatggagctacaatgcagagctgcttgtggctatggagaatcagcacacaatcgatctggcagacagtgagatggacaaactctacgagagggtcaagcggcagctccgggaaaatgccgaggaagatggtaccggatgctttgagattttccataagtgtgacgatgattgtatggcctccattcgcaataacacctatgatcactcaaagtatagggaggaggcaatgcaaaatcgcatccagatcgaccccgtgaagcttagctccggatataaggacgtgatcttgtggttctcttttggtgcctcctgcttcatccttctggccattgtgatgggattggtatttatttgcgtgaagaatggcaatatgcgatgcacaatttgcatc

SEQ ID NO: 528 - DNA, 1680 bp, Influenza A virus
  misc_feature (1)..(1680): Codon Optimized Sequence Encoding H7 Hemagglutinin
atgaatacacagatactggtgtttgcgctgattgccattattccaacaaatgctgataaaatctgcctggggcatcacgcagtttcaaatggcaccaaagtgaacacacttaccgagcgaggcgtggaggtggtgaatgccactgaaacagtggagcgtaccaatatccctcgtatctgtagcaagggtaaacggactgtcgatctgggccagtgtggtttactggggacaattacaggcccccctcagtgtgatcagttcttagagttttcagctgatctgatcatagaacggagagaaggcagcgacgtgtgttaccctggcaagttcgtgaatgaggaggccctgcgccaaatcctgagagagtctggggggatagataaagaagcgatggggttcacttattctggcatccgaaccaatggcgctacgagcgcatgccgcagatctggctctagcttttacgctgagatgaaatggctcctctctaatacggacaatgctgcatttccccagatgaccaaatcttacaagaatacccgtaagtccccagctctcatcgtgtggggaatccaccactctgtgagtactgccgagcagacaaagctctacggctctggaaataagttggtgaccgtaggttcatccaattatcaacagtcattcgtgcctagtcccggtgctcggccccaagtgaacggcctctccgggaggattgacttccattggctgatgctgaaccctaacgatacagtgacattttcatttaacggcgcgtttatagctcctgaccgagcttcctttctccgaggtaagagcatgggcatccagagtggggtacaagtcgatgcgaattgcgagggcgattgttaccacagtggtggcactatcatttccaaccttccttttcagaacattgactcacgggcggtcggcaaatgtcctcgctacgtgaagcaaaggtcccttctgctggccacagggatgaaaaacgtgcctgagatccccaaggggcggggtctctttggggccatcgcaggatttatagaaaatgggtgggagggactcattaatggctggtacggatttagacaccagaacgcccaaggggagggcactgccgccgattataaatccactcagagcgctatcgatcaaataacaggtaaactgaatcggttaattgagaaaaccaatcaacagtttgaactgatagataacgagtttaatgaagtggagaagcagattggaaacgtgatcaactggaccagagactccattactgaggtttggtcgtataacgcggagctgctcgtcgctatggagaatcaacataccatcgacctggctgatagtgagatggacaagctgtacgagcgcgttaaaagacagctgcgtgagaacgctgaagaggatggtacaggatgttttgagatctttcacaagtgtgatgacgactgcatggctagtatccgaaacaatacatacgaccacagcaaatatagagaagaggccatgcaaaatcgtatacaaattgatcccgtgaaactatcctccggctacaaggatgtgatcttgtggttttcctttggcgcatcttgcttcatcctgctggcaattgtaatgggattggtctttatctgcgtgaagaacggcaatatgcggtgtactatctgcatc

SEQ ID NO: 529 - DNA, 1680 bp, Influenza A virus
  misc_feature (1)..(1680): Codon Optimized Sequence Encoding H7 Hemagglutinin
atgaacactcagatcctcgtgtttgccttgatcgccatcataccaacgaatgcagataagatctgcctgggacaccatgctgtatcaaatggcactaaggtgaacaccctgactgagcggggcgttgaagtggtgaacgccactgaaacggtggaaaggaccaatatccccagaatttgctcaaagggcaaaaaaactgttgacctcggccagtgcggcctcttagggacgataaccggtccccctcagtgtgatcagttcctggagttctcagccgatctgatcattgaaagaagagaaggctcggacgtgtgttatccgggcaagttcgtgaacgaagaagccctgcgccagatcctccgcgaaagcgggggcatcgacaaggaagccatgggtttcacctactctggaattcgcaccaacggggccacttccgcatgccgacggtccggttcgagcttttacgctgagatgaagtggcttttatcaaacacagataacgcggctttcccgcagatgaccaagtcctataagaacacaagaaagtctccggccctgattgtctgggggatccaccatagtgtttctactgcggagcagacaaaactttatggtagcgggaacaaactggtcaccgtcggctcctccaattaccagcagagttttgttccctcccccggggcacgaccccaagtcaatgggcaaagtggcaggatagatttccactggttgatgctcaaccccaatgacaccgtgacatttagctttaacggagcttttatcgcaccagaccgggcatcattcctgcgtggcaagagtatgggtattcaaagtggggttcaggtagacgcaaactgcgagggcgactgttatcacagtggggggaccattatcagcaacctaccgtttcagaatatcgatagtagggcagtggggaaatgccctcgatatgtgaagcaacggtccctgctcctggctacgggaatgaaaaacgtcccagagattcccaagggccggggccttttcggcgcgattgctggctttattgagaatgggtgggagggattaatcgacgggtggtatggctttaggcaccagaacgctcagggcgaaggtacggccgcagattacaagtccacccagtccgccatcgaccagattacaggcaagctcaaccgtttaattgagaaaaccaatcagcagttcgagctcatcgataacgagttcaatgaggtggagaaacagattggcaacgtgataaactggactagggactcaatcacagaggtctggagctataatgccgagctgctagttgccatggaaaaccagcatacaatcgatcttgccgactccgaaatggacaaactatatgagagagtcaaacgtcagctaagagagaatgcagaagaggatggcacgggttgcttcgaaattttccacaagtgtgacgacgactgcatggccagcattagaaacaacacatacgatcatagcaagtatagggaggaggcgatgcagaacaggattcagattgatcccgtcaagctctcttctggctataaggatgtcattctgtggttttctttcggcgcctcatgtttcatcctgcttgcaatcgtgatgggattagttttcatttgtgtaaagaacggcaatatgcggtgtacaatctgcatc

SEQ ID NO: 530 - DNA, 1680 bp, Influenza A virus
  misc_feature (1)..(1680): Codon Optimized Sequence Encoding H7 Hemagglutinin
atgaatactcaaatcctggtcttcgcccttattgcgatcatacctaccaacgccgataagatctgcttggggcaccatgccgtctcaaacggcaccaaggtcaacactcttacagaacggggtgtagaagtggttaatgccactgagactgtcgaacgaacaaacatccctcgaatctgcagcaaagggaaacggactgtcgatcttggccagtgtgggctcctgggtaccataacggggcctccccagtgcgaccaattcttagagttctcggccgatttaataatagaacgcagagagggatcagacgtatgttacccgggcaaattcgtcaatgaggaggcactccggcagatcctgagggagagcggcggaattgacaaagaggccatgggattcacttatagtgggattcgtaccaatggcgctacaagtgcctgccgtagatccgggtcgagtttttatgccgaaatgaagtggctactgtccaatacagataacgctgcgttccctcagatgactaagtcttacaagaataccaggaaaagccctgcccttattgtgtggggaattcaccattcggtgagcaccgcggaacaaacaaaactgtacggcagtgggaacaagctcgtgacggtagggtcctctaactaccaacaaagtttcgtcccatccccaggagctagacctcaggtgaacgggttaagcgggcgaattgatttccattggctgatgctgaaccccaacgacacagtgacatttagcttcaatggcgccttcatagctccagacagagcttcctttctgagaggcaaaagtatgggaattcagtctggagtccaagtggatgccaactgcgagggggactgttatcattctggcgggaccattatctctaacctaccattccagaatatagacagtagggccgtagggaagtgtccccgctatgtaaagcagcggagtctgctgctggcaacaggtatgaagaacgtgcccgaaatccccaagggccgcggactctttggggctatcgctgggttcattgagaacggatgggaaggcctcatcgatgggtggtatggttttcgtcaccagaacgctcagggggaaggcaccgccgctgactataaatctactcaatcggccatcgaccagattacagggaagctgaatcgtctaatcgagaaaaccaatcagcaattcgagcttattgacaatgagttcaatgaagtggagaaacagattggaaatgttataaactggacccgggacagcataactgaggtgtggagttacaacgcggagctcctcgttgccatggagaaccagcacaccatagatctggccgatagcgaaatggacaagctgtacgagcgggttaagcgtcaactgcgagagaatgccgaagaagatggcaccggatgctttgaaatattccacaaatgcgatgatgactgtatggcttctatacgtaataacacttacgatcatagcaagtaccgagaggaggctatgcaaaacaggatacagatcgaccccgtgaaactttcatcaggctataaggacgttatactgtggttctcgttcggggcaagttgcttcattctgctcgccattgtcatgggcctggtttttatctgtgtgaagaacggcaatatgcggtgtaccatttgcatc

SEQ ID NO: 531 - DNA, 1680 bp, Influenza A virus
  misc_feature (1)..(1680): Codon Optimized Sequence Encoding H7 Hemagglutinin
atgaatacccagatcttggttttcgcactgatcgcaattatcccaacaaacgcagacaaaatttgtcttggtcatcatgccgtttccaacgggactaaagttaacaccctcacggaacgcggagtagaggtggtcaacgctacagaaaccgtggagcgtacgaacatccctcgcatatgttccaaaggaaagaagactgtcgatctgggacagtgcggcctattagggaccatcaccggccctcctcagtgcgatcaattccttgagttttccgcggatctcataatagagcgcagggagggttccgacgtctgttaccctggcaagtttgtgaatgaggaagccttacggcaaatcttgaggaagtctggcggtattgacaaggaagcgatgggttttacttattccggcatcaggacaaatggggctacttctacttgtcggaggagtggaagcagcttctatgccgagatgaagtggcttctgagcaacactgacaatgccgcctttccccagatgacaaaatcatacaaaaacacacgcaaatcgcccgcaatcattgtctggggcattcatcattctgtctcaaccgccgagcagactaaactctatggctcaggaaataaattagtgaccgtgggatccagcaattaccagcaaagtttcgtgccttccccaggcgcaagaccgcaggttaacggcctctctggacgcatcgactttcattggctcatgcttaaccccaatgatacagtgacattctccttcaatggagcttttatcgctccggaccgtgcttgtttccttcgaggcaagtccatgggaattcaaagtggcgttcaggttgacgccgactgcgaaggtgactgctatcatagcggaggcactatcatcagcaatcttccattccagaacattgactcgcgagccgtgggaaagtgcccaaggtatgtcaagcagaggagcctgctgctggctaccggcatgaaaaacgtccccgaaattccaaaaggccgtggtttgtttggcgccattgccggttttatcgagaacggatgggagggactgattgacggctggtacggcttcagacaccagaacgcgcagggagaagggacggcggccgattataagagcactcagagcgctatcgatcagattaccggtaaattgaatagactgatcgaaaagaccaaccagcaatttgaactcattgacaatgagttcaacgaggtggaacggcagataggaaatgtcattaactggacacgagattctattactgaggtgtggagttacaacgcggagctcctagtcgccatggagaaccagcatacaatcgacctggccgacagcgaaatggacaagctgtatgaaagagtaaagaggcagctgcgggagaacgccgaggaggatggaaccggttgttttgagatctttcacaaatgcgacgatgactgcatggcaagcatccggaacaacacttatgaccacagcaagtatagggaggaggccatgcagaatagaatccagatcgacccagtcaagttaagcagtggctacaaagatgttatcctctggttctcttttggagcctcatgtttcattcttctagcaatcgtgatgggtctcgtctttatttgtgtcaaaaatggaaatatgcgctgtaccatttgtatt

SEQ ID NO: 532 - DNA, 1680 bp, Influenza A virus
  misc_feature (1)..(1680): Codon Optimized Sequence Encoding H7 Hemagglutinin
atgaacactcagatccttgtctttgcgctaattgcaattattccaacgaatgcagacaaaatctgcctgggccatcacgctgtttccaacggaacaaaggtgaacacactcacggaaaggggcgtcgaagtggtgaatgccacggagactgttgagaggaccaacatccccaggatctgtagcaaaggaaagcggacagttgacctgggccagtgtggccttcttggtaccatcaccggacctccccaatgcgaccagtttctggagtttagcgcagaccttatcatcgagcggcgcgaggggagcgacgtctgttacccgggcaagttcgtaaatgaagaggcgctaaggcagatccttagggaatccgggggtatagacaaagaggcaatgggctttacctacagcggaatccggactaatggcgccacctccgcttgtaggcgttcaggatctagtttctacgctgagatgaagtggttgttgagtaataccgataatgcggccttccctcagatgaccaaatcctataaaaatacaagaaaaagcccagccctgatcgtatgggggatccaccattctgtatctaccgcagaacagactaagctctacgggtctgggtccaaattggtaactgtagggagctctaattatcaacagagctttgttccgagtcctggcgccaggccccaggtgaacggtctgtccgggagaattgattttcactggctcatgctcaatcctaatgatacggttaccttcagctttaatggagcgttcatcgcacccgatagggcttcatttttacgtggcaagtccatgggaatccagtcaggagtccaggtcgacgctaattgcgagggtgattgctaccacagcggaggaactatcatttcgaacctcccctttcagaatattgattctagggccgtcggtaaatgtccaagatatgtgaagcaaaggtctttgctactcgccactggaatgaaaaacgtgcctgaaatccctaaaggccggggcctgtttggcgcaatcgctggatttatcgagaatggttgggagggactgattgacggctggtatggattccggcaccaaaacgctcagggggaaggcactgctgccgattacaagtccactcaatccgcgattgaccaaataaccggtaagctgaataggctgatcgagaagacaaatcagcagtttgagctcatcgataacgagtttaatgaagtagaaaagcagattgggaacgttattaattggacaagagatagtataaccgaggtgtggagctataatgcggagctcctggtggccatggaaaatcagcatacaatagacctcgccgatagcgaaatggataaattatacgagagagtgaagcggcagctgagggaaaacgctgaggaggacggaactggctgttttgagatctttcataagtgcgatgatgactgtatggccagcattcggaacaacacctacgatcattctaagtatagggaggaggcaatgcagaaccgaatccaaatagatcctgttaagctgtctagcggatataaagacgtgatactttggttcagcttcggggccagctgtttcattctgcttgctatcgtcatgggacttgtatttatctgcgtgaagtccagaaacatgaggtgcactatatgtatc

SEQ ID NO: 533 - DNA, 1680 bp, Influenza A virus
  misc_feature (1)..(1680): Codon Optimized Sequence Encoding H7 Hemagglutinin
atgaacactcaaatcctggtgttcgcgctgatcgccatcatacctaccaatgctgacaaaatctgcttgggccaccacgccgttagcaatggaaccaaagtgaacacgttgacggaaagaggagtggaggtggtgaatgccacggaaacagtggagcggacaaacatcccccggatctgtagtaaagggaaaaagacggttgatctcggccagtgcggcctcctggggacaataaccgggcctcctcaatgtgaccagttcctggaattctcagccgatttaatcatagagcggcgggaggggagtgatgtgtgttatccagggaaattcgtgaatgaagaagccttgagacagatccttcgcgaaagtggaggaatcgacaaggaggccatgggctttacttatagtggaatcagaaccaacggcgccacgtccgcatgccgacgcagcggttctagcttctatgccgaaatgaagtggctgctctccaataccgataatgcagccttcccccaaatgacgaaatcttacaagaatacccgcaaaagtcctgctttgattgtctggggcatccaccacagcgtctctactgccgaacaaacaaagttatacggatcaggcaacaaactggtcaccgtaggttccagcaactaccaacagtcatttgtcccgagccctggagcccgcccacaggtgaacgggcagtccggccgaattgactttcactggctgatgctcaacccgaacgatactgtgaccttcagcttcaatggcgcgttcattgcacctgaccgtgcatcattcttgaggggcaaaagcatggggatccagtctggagtccaggtcgacgcaaattgcgaaggagattgttatcacagcgggggcacgattatctcaaatctcccctttcaaaatatagatagccgagcagttggcaaatgccctcgctacgtgaaacaaaggagcctgctcctggctaccgggatgaagaacgtacctgaaatccccaagggacgcggacttttcggcgctattgctgggttcatagaaaacggctgggaagggttgatcgacggctggtatggcttcagacaccagaatgctcagggagaaggcacagcagccgactacaaatcaacccagtctgccatcgatcagattacaggaaagctgaatcggctcatcgagaaaactaaccagcagttcgaactcatcgacaatgagtttaacgaggtcgaaaaacagattggtaatgtgatcaactggactagggactccattacagaggtttggtcctataatgccgagcttttggttgccatggaaaaccaacataccatcgacctggccgatagcgagatggacaagttgtacgagagggtaaaaaggcagctcagagaaaacgccgaggaagatggaaccggttgtttcgaaatttttcataagtgcgatgacgactgtatggcttcaattcgaaacaatacttacgatcacagcaagtaccgcgaagaggccatgcagaataggattcagattgatcctgttaagttgtcatccggctataaggatgtaatcttatggtttagtttcggcgctagctgcttcatactgctggcaatcgtgatggggctggtatttatatgcgtcaaaaatgggaatatgcgctgtaccatctgcatc

SEQ ID NO: 534 - DNA, 1680 bp, Influenza A virus
  misc_feature (1)..(1680): Codon Optimized Sequence Encoding H7 Hemagglutinin
atgaatactcaaatcttggtctttgcactgatcgccattattcctactaacgccgataaaatttgcttgggtcatcacgccgtgtcaaatggcactaaagttaataccttaacagagcgcggagtagaggtggtgaatgcaacggagactgttgagcggaccaatataccccgcatttgtagtaaaggcaagaaaacagtggacctgggccaatgcgggttgcttgggacgatcaccggccccccgcagtgcgatcagttcttagaattctccgctgacctaatcatcgaaagacgggagggcagcgatgtgtgttatcctggcaaattcgtcaacgaggaagccctcaggcagattcttcgcaagtcagggggtattgataaggaggcgatgggattcacatactccggaattcgaacaaacggcgctacaagtacttgtaggaggagcgggagttcattctacgcagagatgaagtggctgctcagcaacaccgacaacgcagcgttcccacagatgaccaaaagctataaaaatacccgaaagagtcccgcaatcatcgtatggggaattcatcacagtgtctctaccgctgagcagaccaagttgtatggctccggcaacaagctcgttaccgttggcagctcaaattaccaacagtccttcgtcccctccccaggggcaaggccccaagtcaacggcctgtccggcagaattgacttccactggctcatgctaaaccccaatgatacggtcaccttcagttttaatggggcattcatcgcacccgacagagcctgttttctgcgaggtaaatcaatgggtatacaatccggggtccaggtcgacgctgactgcgagggcgactgctatcattcgggaggcaccattatttccaacctgcctttccagaacattgattccagagccgtgggcaagtgtcctcggtacgtgaaacaacgatctctgcttctggctaccggaatgaagaacgtgcccgagatccccaagggacgaggcctgttcggggccattgccggatttattgagaatggctgggagggtctcatcgatggatggtacggcttcaggcaccagaacgcacaaggtgaaggcacagctgctgattacaaatccacccagagtgcaattgaccagatcaccggaaaactcaatagactgattgaaaaaaccaaccaacagtttgaattgattgataatgagtttaacgaagtcgaacggcagattggtaatgtgatcaattggacccgggattccattacagaggtttggtcctacaacgccgagctgctcgtcgcaatggaaaatcagcacaccatagatctggccgactccgagatggacaagctttacgaaagggtgaagagacagctcagggagaacgccgaagaggacggaacagggtgtttcgaaatcttccataagtgcgacgatgattgtatggcttctatccggaacaacacctatgatcactccaaatatagagaggaagcaatgcagaacaggattcaaatcgaccctgtcaaactctcaagtgggtacaaggacgtaatcctatggttcagctttggcgccagctgttttattctgctggcaatcgtgatgggtttggtgtttatctgcgtcaagaatggcaacatgaggtgtaccatttgcatc

SEQ ID NO: 535 - DNA, 1680 bp, Influenza A virus
  misc_feature (1)..(1680): Codon Optimized Sequence Encoding H7 Hemagglutinin
atgaatacacagatcctggtcttcgcccttatcgctatcatccccacaaacgccgacaagatatgcctgggccaccacgccgttagcaacggcaccaaagtaaacactctcactgaaaggggtgtggaagttgtgaacgcaacagaaaccgtagaacgcacgaacattccaagaatttgctcaaaggggaaacgtacagtcgatctaggacagtgcggcctgctcggcaccataaccgggcccccccaatgcgatcaatttctggagttctctgccgatcttatcatcgagcgtcgggaagggagcgatgtgtgctaccccggcaaatttgtgaacgaggaggccctcagacagatcttaagagagtctggagggattgacaaagaggccatggggttcacatactccggcatacgtacgaatggggccacgagtgcttgtcggaggagcggttcaagtttctacgcggagatgaaatggctgctgagcaataccgataacgccgccttcccccagatgaccaaaagttataaaaatacaaggaaatcacccgcccttatcgtttggggaattcatcactccgtcagtaccgccgaacagactaagctctatggatcgggttcaaagctagtgaccgtgggctcaagcaattaccagcaatcctttgtaccaagccctggggcccgtccccaagtgaacggattaagcggtaggattgacttccattggttgatgctcaatccgaatgatacggtgaccttcagtttcaacggggcgttcatagctcctgatcgcgcgagcttcctccggggaaaatcgatgggaattcagtcaggcgttcaggtggacgccaattgtgaaggagactgctaccatagcggagggactataatttccaatctgccttttcagaacattgactcccgcgctgtggggaagtgtccccggtacgtgaagcaacgctccctgcttctcgccacaggcatgaagaacgtacctgagattcctaagggccgggggcttttcggcgcgattgctggattcatcgaaaacggctgggaaggtttaatagatggctggtatggcttcaggcaccagaatgcacagggcgaggggaccgcggccgactataagtctacccaaagtgctattgatcagataaccggaaagcttaaccgcctgatcgagaaaaccaatcaacagtttgaacttatcgacaacgaattcaacgaggttgagaagcagattgggaacgtcattaattggacccgagattcgatcacagaggtgtggagctacaacgccgagctgctggtcgcgatggaaaatcagcatacaatcgacttggccgatagtgagatggacaaactatacgagagagtgaaacggcagctgagggagaacgccgaagaggacggcaccgggtgctttgagatttttcacaagtgcgatgacgattgtatggcttccatcaggaataatacttacgaccacagtaagtatcgcgaagaggctatgcaaaaccgcattcagatcgaccccgtcaaactctcatcgggctataaagatgtgatactctggttttcttttggtgcatcatgcttcattcttttggcaatagtgatggggctggtgttcatctgcgtaaagaacggtaacatgagatgcactatctgtatt

SEQ ID NO: 536 - DNA, 1680 bp, Influenza A virus
  misc_feature (1)..(1680): Codon Optimized Sequence Encoding H7 Hemagglutinin
atgaatacacagatcttagtgtttgctttaatagctattattccaaccaatgccgataaaatctgtctgggacaccacgccgtgagcaatgggacgaaagtgaacactcttaccgaacgaggagtcgaggttgtcaatgctacggaaactgtggaaaggaccaacatcccaaggatctgcagcaaaggcaaaaaaactgtagatctggggcagtgtggactgctggggaccattaccggacccccccagtgcgaccagttcttggagttttccgccgatctgattattgagcggcgcgaggggtctgatgtgtgctatcctggtaaatttgtcaacgaagaggcgctgcgacaaattctccgcaaaagtgggggaatcgacaaggaagccatgggcttcacatactctggcattcgaacaaatggggccacttccacatgcaggcggtctgggtcttcattttatgccgagatgaagtggcttctttctaatactgacaacgccgccttcccccaaatgaccaagtcctacaaaaacacccggaagtccccagccattatcgtctggggaatccatcacagcgtttctacagccgaacagaccaagctctacggatcaggaaacaaactggttacagtgggtagcagcaactatcagcagtcgttcgttccttctcctggggcgcggccgcaagtaaacgggctcagtgggcgtatcgatttccactggctgatgctgaacccaaacgacacagtcaccttcagctttaatggagccttcatcgcccctgatagggcctgctttctgcggggaaaatccatgggcatccaaagcggagtgcaggtcgacgccgattgcgaaggggactgctaccattctggtgggaccatcatctccaacctcccatttcagaacattgactcccgggcggtcggaaaatgcccacgttacgtgaagcagcgcagtctcttactcgccactgggatgaagaacgtgcccgaaattccaaaggggcgtggtctgtttggggcgattgccggcttcattgagaacggctgggaggggcttatcgacggctggtacggattccgtcaccagaatgcccagggtgagggcaccgcagcagactataaaagcacacagagcgccattgaccaaatcactgggaagctgaatcgcctgattgagaaaactaaccagcagtttgaactcatagataatgaatttaacgaagtcgaaaggcagattggcaacgtaattaattggactcgcgactcaatcactgaggtctggagttacaatgcagaactgcttgtcgctatggagaaccagcataccattgacctggctgatagcgagatggataaactgtacgaaagggtgaagcgacagctccgcgagaacgcagaggaggacgggaccggctgtttcgagatctttcacaagtgtgacgacgactgtatggcttcgattcggaacaacacctatgaccactccaaatatagggaagaggctatgcagaataggatccaaatcgatcctgtgaagctgagctccggctacaaagacgtaatcctgtggttctcttttggcgcctcgtgttttatcctactcgccatcgtcatgggtttagtttttatctgcgtaaaaaatggaaatatgagatgtactatctgcatc

SEQ ID NO: 537 - DNA, 1680 bp, Influenza A virus
  misc_feature (1)..(1680): Codon Optimized Sequence Encoding H7 Hemagglutinin
atgaacacgcagatccttgtcttcgccctgattgccattatacccactaacgccgataaaatttgcttgggccaccacgccgtgtccaatggaacaaaagtgaatactttgaccgagaggggtgtcgaagtcgtcaacgccaccgagactgtcgaacggacaaatataccgcgtatctgttctaaagggaagcgaaccgtggacctgggtcaatgcggactgctggggactattacagggccccctcagtgcgatcagtttctggaatttagcgctgacctcattattgaaaggagggagggatcagatgtgtgttacccaggtaagtttgtcaatgaggaagccctccgacagattctcagggaatctggaggcattgataaagaggctatggggttcacctattcaggcatcaggaccaatggggctaccagcgcttgccgccggagcggatcatctttttatgccgagatgaaatggctactgtcaaacaccgacaacgccgcattcccacagatgaccaagagttacaagaatacacgcaagtcacccgccctcatcgtctggggcatccatcattccgtgagcacagccgagcagacgaagctctacggatcgggcagcaagctcgtaaccgtcgggagctctaactatcagcaatcttttgtgccctcccccggagcccggccacaggtcaatggactatccgggcgcatcgatttccactggctgatgttgaacccgaacgacaccgtgacattttcattcaatggggcattcatcgcgccagaccgcgcgtcctttctgaggggaaagtccatgggtatccagtctggtgtacaggtggatgccaactgtgagggtgactgctaccatagtggaggaacaattatctccaacttgccattccaaaacatcgacagtagagctgttggtaaatgtcccaggtacgtgaagcaaaggtcattgctgctggccactgggatgaagaatgtgcccgaaattccaaaaggaagggggcttttcggggcaatcgccggcttcattgagaatggctgggaaggcctcatcgacgggtggtacgggtttaggcatcaaaacgcgcagggggaggggacagctgctgattacaagagtacacagagcgcaatcgaccagatcaccgggaaactaaatcgcctcatcgagaagactaatcagcagttcgaactgatcgacaacgagttcaacgaggtcgaaaaacagattggtaacgtcattaactggaccagagattccataaccgaagtctggtcctataacgcagaactgctggtagccatggagaaccagcacactatcgacctggcagactcggaaatggataaactgtacgagagggtgaagcggcagctccgggagaacgctgaagaagatggtaccggctgtttcgaaatttttcacaaatgtgacgatgattgtatggcctctatacgcaacaatacctacgatcactccaaatacagggaggaggctatgcagaatcgtatccagatcgatccggtaaaactgagtagcggatataaggatgtgatcctgtggttcagcttcggggctagttgctttattctgttggcaattgtgatgggcctggtgttcatttgcgtcaaaaatggcaacatgcgctgcaccatttgtatc

SEQ ID NO: 538 - DNA, 1680 bp, Influenza A virus
  misc_feature (1)..(1680): Codon Optimized Sequence Encoding H7 Hemagglutinin
atgaacacccaaatattagtgttcgcattgattgcgattatcccaaccaacgcagataagatctgcttgggacatcacgctgtcagcaacgggaccaaggtgaacacgttgacagagaggggcgtagaagtggtcaacgccactgagacagtggaacgcaccaacataccgcggatctgctccaagggaaagcgcacggtggatcttggccagtgcggcctgctgggtacgataactggacctccccagtgcgaccagttcctggagttctccgccgacctcatcatcgaaaggagagaaggtagcgatgtctgctacccagggaaattcgttaacgaagaggcccttagacaaatcctgagagaatctggcgggatcgataaggaggcaatgggatttacttactcaggaattaggactaacggggctacctctgcgtgccgacggtccggttcgagcttctatgccgagatgaaatggcttttgagcaacaccgataatgctgcttttccccagatgactaagtcctataagaataccagaaaaagccccgccttaattgtgtggggcatccaccactcagtgagtacagccgaacaaacgaaactgtacggctctggttccaagttggtcacagtcggatcctcaaattatcagcagagcttcgtaccctctccgggtgcgagaccacaggtgaacggcctgagtggtcggattgacttccactggctcatgctgaaccccaacgataccgtaactttctctttcaacggagcctttatagctcctgatagagcttcttttctgcgtgggaagtccatggggatccagagcggcgtgcaggtggacgcgaactgtgagggtgactgctatcactcaggaggaacaattatctcgaatcttccttttcaaaacatcgactcccgagccgtcggaaaatgccctcgctatgtgaaacagcggagcttgttgctcgccacggggatgaagaacgtccctgaaataccgaaggggcggggcctgtttggagcaatcgcaggatttatcgagaacgggtgggaagggcttattgatgggtggtatggcttccgccaccaaaacgctcaaggcgaggggactgctgctgattataaatcgacacagtctgctattgaccagattacaggaaagctcaaccgattgatagaaaagactaaccagcagtttgagctgatcgataatgaatttaacgaggtggagaagcagatcgggaatgtgatcaactggaccagagattccatcactgaagtttggagttacaacgccgagctcctggtggctatggaaaatcagcataccatcgacctcgctgacagtgagatggacaagctctatgaaagagttaagcgacagctgcgagagaatgccgaggaggatggtacaggctgctttgagattttccacaagtgtgatgatgactgtatggcctcaatacggaataatacatatgatcactccaagtatcgggaggaagccatgcagaaccgtatccagatcgaccctgtgaaactgagctctggatacaaggatgtcatactctggttctcattcggtgcttcttgttttattctgctggccattgtgatgggcctcgtgtttatatgcgtaaagtcccgcaacatgagatgcaccatctgtatc

SEQ ID NO: 539 - DNA, 1680 bp, Influenza A virus
  misc_feature (1)..(1680): Codon Optimized Sequence Encoding H7 Hemagglutinin
atgaatactcagatactggtattcgctctcattgctattattcctacgaacgcagataagatttgcctaggccatcatgctgtctctaacggcactaaggtcaacaccctgaccgagcgcggagtggaggtagttaacgcaactgaaacagtcgaacgcaccaatattcccagaatctgctcgaagggaaagaagaccgtcgatctggggcaatgtgggcttctcggcaccatcacgggccctccacagtgtgaccagtttctggaattttccgccgacctgatcatagagcgccgggaaggatccgatgtgtgttatcccgggaagttcgtgaacgaggaagcactgcgacagatcctgagggagtccggcgggattgacaaggaggccatgggcttcacttatagcggtatacgtaccaacggtgcaaccagtgcttgcaggcgatccgggtcctccttctacgctgagatgaagtggctcctctccaatacagacaacgccgcctttccacagatgactaaaagttataagaacacacgcaagtcccccgcgctgatcgtgtgggggattcatcatagcgtgagcaccgcggagcagacaaaactctacggaagcggtaacaagctggtaacagtgggatcttctaactaccaacagagtttcgtgccttccccaggtgcgcgcccccaggtaaacggacagagtgggagaatcgacttccactggctgatgctgaatcccaacgatactgtcacctttagttttaatggtgcatttatcgcccctgatagagcatccttcttacgggggaagagtatggggattcagtcaggcgtgcaggttgacgctaactgcgagggcgattgttaccactcgggcgggactataatctcgaaccttccctttcaaaacatagatagccgggccgtgggcaaatgtccgagatacgtgaaacagaggagtctgttgctggctacgggcatgaagaacgtgccagaaattcctaagggccgcggtctgttcggagcaatcgcagggttcatcgagaatggctgggaagggctgatcgatggttggtatggattcagacaccagaacgcgcagggggagggaacagccgctgactataaatccacacagagcgctatagatcaaatcacagggaaacttaacaggctgatcgagaaaacaaaccagcagtttgagttgattgataatgagttcaacgaggtggagaagcaaatcggcaacgtcatcaattggactcgcgattctatcactgaggtatggagctacaatgcagagctgctcgtagcgatggagaatcagcatacaattgatctggccgactccgaaatggacaagctgtatgagcgcgtaaagagacaacttagagaaaatgccgaggaagatggcactggctgcttcgaaatctttcataaatgcgatgatgactgtatggcatctatcagaaacaacacttatgaccactccaagtatagggaagaagctatgcagaatagaatccagatcgatcccgtaaaacttagttccgggtacaaggacgttattctttggttttctttcggcgcaagctgtttcatccttcttgcaatcgtaatgggtctcgtcttcatctgcgttaaaaatggcaacatgcgttgcacaatttgcatt

SEQ ID NO: 540 - DNA, 1680 bp, Influenza A virus
  misc_feature (1)..(1680): Codon Optimized Sequence Encoding H7 Hemagglutinin
atgaatacccagatcctggtctttgcgctgatcgctattatcccaactaacgccgataaaatctgcctgggccaccacgctgtcagcaatggcacaaaggtaaataccctaacagagcggggggtggaagtcgttaatgctactgagaccgtggaacgaacaaatattcctaggatctgttccaagggcaagcgcactgtggacttgggtcagtgcggcttacttggtacaatcactgggccgccacagtgcgaccagtttctcgagttctcggccgatctgatcatagaaagaagggagggcagcgacgtgtgctaccccggcaagtttgttaacgaggaggcactgcggcagatcctgagagaaagcggaggcatcgacaaagaggcaatggggttcacctactctggcattaggactaacggtgcaacttctgcctgccggagaagcggttcttccttctacgccgaaatgaagtggctgctgtccaatactgacaacgctgcctttcctcagatgacaaagagttacaaaaacacacggaaaagcccagctctgatcgtgtggggcatccaccatagtgtaagcacagctgaacagacgaagctgtacgggtctggcaataaacttgtcacagttggatcgtccaattaccaacagagcttcgtccccagtccaggtgagagacctcaggttaacggcctctcggggagaatcgacttccactggctgatgcttaaccccaacgacacagtaaccttctcctttaacggcgcctttattgctcctgatagggcctcctttttgagaggaaaaagtatgggcatccaaagcggggtgcaggtggacgccaactgtgaaggcgactgctaccactcggggggcaccataatatccaacctaccttttcagaatattgactctcgggccgtggggaagtgtcctcgttacgtgaagcagcgaagcctcctactcgcaaccggcatgaagaacgtcccagagatcccaaagggtcggggcctgttcggtgccattgccgggtttatagaaaacgggtgggaaggcctgatcgatggctggtatggcttccgccatcagaacgcacagggtgagggcacagcagcagactataaaagcactcaatcggccatcgaccagatcacggggaagttaaataggctgattgaaaagacaaaccaacaattcgaacttattgataacgagtttaacgaagtggagaagcagataggaaacgttatcaattggacgcgagattccataacagaagtttggtcatataatgccgagctcctagtcgccatggaaaatcagcacactattgatctggctgattccgagatggataaattatatgagagagtgaagcgccagcttagggaaaacgccgaagaggacggaactgggtgtttcgagatctttcataaatgcgatgatgactgcatggcctctattcggaataacacatacgatcactccaagtatcgggaggaggcgatgcagaacagaattcagattgatccagtgaagctgtccagcggatacaaagacgtgatactatggttcagctttggtgctagttgctttatcctgttggcgatcgtcatgggcctggtattcatttgcgtgaagaatggtaacatgcgctgcaccatatgtatt

SEQ ID NO: 541 - DNA, 1680 bp, Influenza A virus
  misc_feature (1)..(1680): Codon Optimized Sequence Encoding H7 Hemagglutinin
atgaacacacagatactggtgttcgcactgatagccataatacctaccaatgctgataaaatttgtcttggtcaccatgccgtcagcaatggaacaaaagtcaatactctgacagagaggggagtcgaagtggtgaacgcaacagagacggtagaacggacaaacattccaagaatctgttccaaaggtaagaggacggtcgatctcggacagtgcggcctattaggaactattactggtcctccgcagtgcgaccagtttctggaatttagcgcagacttgattatagagcggcgagaagggtccgatgtatgctatcccggcaaattcgtgaatgaggaggccctgcgacagattttgagagaaagcggggggattgataaagaagcgatggggtttacatattcaggcatcaggaccaatggcgctacctcagcttgccgaagaagtggtagctctttttatgccgaaatgaagtggcttctttcaaacactgataacgcagccttcccacagatgaccaagagctacaagaatactcgtaaatcaccagccctaattgtgtggggtatccaccattcagtctctaccgcagaacaaacaaaactgtacggcagcgggaacaagctagtgaccgttggatccagcaattaccagcaaagctttgtcccttcccccggcgcacgtccacaggtaaacggcttgagcgggagaattgatttccactggctaatgctaaatcccaacgataccgttacttttagcttcaatggggctttcattgccccagatagagcctctttcctgagaggtaaaagtatgggcatccaatccggggtgcaggtggatgcgaattgtgaaggcgattgttaccacagcggggggaccattatttccaacttacccttccaaaacatcgattcgcgagcagtgggcaaatgtccccggtatgtcaagcagaggtcgctgttgctggccaccggcatgaaaaatgtccctgagattccaaaaggtcgcggtttgtttggcgctattgcgggatttatcgagaacggctgggaggggctgattgacgggtggtacgggttcagacaccagaacgctcagggcgagggaaccgctgcggattataaaagcacgcagtcggccatagaccagatcacaggcaagctcaataggctcatcgagaagacgaatcagcaattcgaattgatagataacgaattcaacgaggtggagaaacagattgggaatgtgatcaattggacaagggattcaattacggaagtgtggtcctataacgccgagctgctcgtggccatggagaatcagcatacaatcgatctggccgacagtgagatggataaactctacgaacgtgtgaagcggcagctacgcgagaacgccgaggaagatgggacaggctgttttgagatcttccacaagtgcgacgacgactgtatggcgtcaatccgcaataacacatacgaccacagcaagtaccgagaggaagccatgcaaaacaggatccaaatcgatcctgtaaagctttcctctgggtataaagacgtcattctttggttctcttttggagccagttgcttcatccttctagccattgtgatggggctggtattcatctgcgtgaaaaatgggaatatgcgatgtaccatatgcatt

SEQ ID NO: 542 - DNA, 1680 bp, Influenza A virus
  misc_feature (1)..(1680): Codon Optimized Sequence Encoding H7 Hemagglutinin
atgaatacccagatcctcgtttttgctctgatcgcaattattcccactaatgcagacaaaatctgtctcggtcatcatgctgtgtctaatggaacgaaggtcaataccctgaccgaacgcggtgtcgaagtggtcaatgcgacagaaactgtagaacgaaccaatatccctaggatttgttccaaggggaagaagactgttgacttggggcaatgcgggctcctaggcaccattacgggccccccccaatgtgaccagttcctagagtttagcgcagatctgatcatcgaaagaagggaaggctccgatgtgtgctatcccgggaagttcgtgaatgaagaggcgctgaggcagattctcagagagagcggcggtattgagaaagaagctatgggatttacatatagcgggattcgcgcaaacggcgcaactagtgcgtgtcgacgcagcggttcttctttctatgccgagatgaagtggttactaagcaacaccgataacgccgcgttcccccagatgaccaagtcttataagaacacacgcaaatcccccgcgctcattgtgtggggaattcaccacagcgtctctactgcagagcagacaaaactgtacggttcagggaataagctcgtaactgtagggtcaagtaactaccagcagtcctttgtcccttctccaggggctcggcctcaggtcaatgggctgagcggccggatcgatttccactggctgatgctgaatcccaacgacaccgtgactttctctttcaacggggcctttatcgccccagatcgggccagctttctgagagggaagtcaatgggaatccagtctggagtccaggtggatgcgaactgtgaaggggattgctaccacagcggcgggactatcatctccaaccttccattccaaaacattgactctcgcgccgttggcaagtgtccacgatacgtcaagcagaggtctctgctcctggctaccggaatgaagaatgtgcccgagatacccaaaggccgtggcctgttcggcgcgatagctggctttattgaaaacggatgggagggattgatagacggctggtacggctttcgccatcagaacgcgcagggcgaaggaaccgccgccgattataaatcaacacagtcagctatcgaccagataaccggcaagctgaaccgattaattgaaaaaacaaaccagcagtttgaactgatcgataatgaattcaacgaagtggaaaaacagattgggaatgttataaattggactcgggactccatcactgaagtttggtcttacaatgccgaattactggttgccatggaaaatcaacacactatcgatctcgcggacagcgaaatggacaagctttacgaacgcgttaaacggcagcttcgtgagaatgcggaagaggatggaacgggctgcttcgagatcttccataaatgcgacgacgattgtatggcctcaattaggaataacacctacgatcacagcaagtaccgggaggaggccatgcagaaccgcattcaaattgatcccgtcaaactctcgagcgggtataaagatgtgatcttgtggttctcttttggtgcttcctgctttatcctactggccattgtcatgggactggtgttcatctgcgtcaaaaacgggaacatgcgctgtaccatctgtatt

SEQ ID NO: 543 - DNA, 1680 bp, Influenza A virus
  misc_feature (1)..(1680): Codon Optimized Sequence Encoding H7 Hemagglutinin
atgaacacccagatccttgtctttgctctgattgctatcatccctacaaatgcggacaagatttgtctgggtcatcatgcagtatccaacggaaccaaagtcaacaccctaaccgaacgcggcgtagaagtggtcaacgccaccgagaccgtggaacgcacaaatattcctaggatctgctcaaaaggtaaaaagacagtggatttgggccagtgtggtctgctggggactataactggccccccccaatgcgatcagttccttgaatttagcgccgatctcattatagaacggcgggagggcagcgatgtttgctatccaggaaagtttgtcaatgaagaagcactaaggcagattctgagagaatctggaggaatcgacaaggaggccatgggattcacgtactccggcattcgcacaaatggggccacctcagcttgtaggcgcagtggcagcagcttttacgcggagatgaagtggttgctttccaatacagataacgctgcattcccccagatgacaaaaagctacaagaatacacgaaaatcccccgctctgatagtgtgggggatccaccatagtgtgtcaaccgccgagcaaacgaagttgtatggctccggaaacaaattggtgactgtcggttcatccaactaccagcagtcttttgtgccttctcccggggcccgacctcaggtaaatggtcagagcggtcggatcgacttccactggctcatgctgaatcccaacgacacagttactttttcattcaatggggcattcattgcgccagacagggcctcctttctaaggggtaagtcgatgggaatacagtctggcgtgcaagtagatgcaaattgcgaaggggactgctatcactctgggggcacgatcatcagtaacctgccttttcagaacatcgacagccgagcagtaggaaaatgcccacgctacgtgaagcagcgctcactgctcttagccaccgggatgaagaacgtcccagaaattcctaaaggaagggggctgttcggcgcaattgctgggtttattgagaatggatgggagggtctgatcgatggctggtacggtttcagacaccagaacgcccaaggcgaaggcacagccgctgactataagagtactcaaagtgcaattgaccagattaccggcaagttgaatcgtctgattgaaaagacaaatcagcagttcgaactgatagataatgagtttaatgaggttgagaaacagataggcaacgtgattaactggaccagggactcaatcacagaagtgtggagctacaacgcggaattactagtggcaatggaaaatcagcatactatcgaccttgcagattctgaaatggacaaactgtatgaaagagtgaaacgccagctccgtgaaaatgccgaagaggacgggaccggttgttttgagattttccataagtgtgacgacgattgtatggcaagcatccgtaataatacatacgatcattcgaagtatcgcgaggaggcaatgcagaacaggatacaaatcgatcctgtaaaactgagtagtgggtataaagatgtgattttgtggttctcatttggcgcctcttgtttcatcctcctcgctatcgtgatgggactggtgtttatctgcgtgaagaatggtaacatgcggtgcactatatgcatc

SEQ ID NO: 544 - DNA, 1680 bp, Influenza A virus
  misc_feature (1)..(1680): Codon Optimized Sequence Encoding H7 Hemagglutinin
atgaatacccagatcctagtgtttgcccttattgccatcataccgacaaacgccgacaagatatgcctaggacatcacgctgtctcaaacggtaccaaggttaacacgttgacggagcgaggagttgaggtggtgaacgctactgagaccgtggaacgcactaacattccccgcatttgtagtaaaggcaagagaactgtcgacctgggacagtgcggcctcttagggaccatcacaggacccccgcagtgtgaccagttcctcgaattttctgctgacctgatcattgagcggagagaggggagcgatgtgtgctaccccggaaaattcgtaaatgaagaagcactgcgacagattctgcgggagagtggcggaattgataaggaagctatggggtttacatacagcgggatcaggactaacggagcgaccagcgcttgcaggcggtcaggaagttctttctatgcagaaatgaagtggctgctgtccaacacggacaatgctgctttcccccagatgactaaatcctacaaaaatactcgaaaatctcccgcccttattgtttgggggatccatcacagcgtgtcgaccgccgaacagacaaagctctatggaagcggtaacaagcttgtgaccgttggatcttccaattatcagcagtcctttgtcccctctcctggtgccagaccccaggttaatggcctaagcgggcgcatcgactttcattggctcatgctgaaccctaatgataccgttacgtttagttttaatggcgccttcattgcccctgacagagcatctttcctgcgagggaagtcaatgggcatccagagcggtgtacaggtggacgccaattgtgagggcgattgttatcactccgggggaacaattattagtaatctgcccttccagaatatagattcgagggcggtaggtaagtgtcctcgctacgttaaacaacgctctcttcttttggccactgggatgaagaacgtacctgaaatacctaagggtcgcgggctctttggcgcgatcgcaggcttcattgaaaacggctgggagggtttaatcaacgggtggtacggtttccgacaccagaacgctcagggggaaggtaccgctgcagattacaagtccactcaatcagctattgatcagatcacgggcaagctgaacaggctcatcgaaaagaccaatcagcaattcgaactcatcgataacgagttcaacgaggtggagaagcaaattggaaatgtaataaattggacgcgcgattctattacagaagtgtggtcctacaacgcggaactcttagtggcaatggagaaccagcatactattgacctggctgactcagaaatggataagctgtacgaaagggtgaaaagacagttgagggaaaatgctgaggaagatgggacgggatgctttgagattttccataagtgcgatgatgactgcatggcaagcatccgtaacaacacatatgaccattctaagtaccgggaggaagccatgcaaaatcgcatacagatcgaccctgtgaagctcagttctggctacaaagatgtgatcctgtggttttcgttcggagccagctgctttatcctacttgcaatagtcatgggtcttgtgttcatatgcgtaaagaatggcaacatgaggtgtaccatctgtatc

SEQ ID NO: 545 - DNA, 1680 bp, Influenza A virus
  misc_feature (1)..(1680): Codon Optimized Sequence Encoding H7 Hemagglutinin
atgaacacccagattctggtgtttgccctgattgctataattccaaccaatgcggacaaaatctgcctgggccaccacgccgtgtcgaacggcacgaaagtgaataccttaacggaaagaggcgttgaagttgtgaatgcaacagaaactgtagaaagaactaatattcctagaatctgttctaaggggaaaaaaacggtggacttaggccagtgtggtctgctagggactatcaccggcccccctcaatgtgaccagttcctggagttcagcgccgacctcattatagaaagaagagaaggatcagacgtgtgctaccctggcaaattcgtaaacgaggaggccctccggcagatcctccgcgaatccggtggaatcgacaaggaagccatgggatttacctattctggtattcggaccaacggcgccacgagtgcttgtcggcggtcagggtcttccttttacgcagagatgaagtggctcctgtccaatactgacaatgccgcattccctcaaatgactaagtcctataaaaataccagaaaatctcctgcacttatcgtgtggggcattcatcactctgtcagtactgccgagcagaccaagctatacgggagcggtaacaagcttgtgacagtagggtcatccaactatcagcaaagctttgtaccgtcccctggggcacgtccccaggtgaacggccagtccgggcggatcgacttccactggttgatgctgaatcctaacgataccgtgaccttctctttcaacggggcatttatcgcaccagacagggcttcctttctgcgcggaaagtccatgggcatccagtccggcgtgcaggtcgatgcaaactgcgagggtgattgctaccattctggggggacaataatctctaatctgccttttcagaacattgacagtcgagcggtgggcaagtgtcccaggtacgtgaaacaacgctcccttctgttggcaacagggatgaagaacgtgcctgagatcccgaaaggccgtggattatttggcgctattgctggcttcattgagaatggatgggagggcttaatcgacggttggtacggcttccggcatcagaatgcacagggcgaaggaacagctgccgactataaatccacccagtccgcaatcgatcagataaccggcaagctgaaccggctcattgagaaaacaaatcagcagttcgagctcatagacaatgagtttaacgaggtagagaaacagattggtaatgtcattaactggacacgggatagcatcacggaagtttggagctataatgctgagctcttggtcgctatggagaaccagcatacgattgacttggcagactctgagatggataagctttatgagcgcgtgaagaggcaacttagagagaacgctgaggaggacggtactgggtgcttcgagatattccataagtgcgacgatgactgcatggccagcattagaaacaacacatatgatcactccaagtatcgtgaagaagccatgcagaatcggattcagattgatccagtgaagctgtcctccggctacaaggatgtgatcctgtggttctcgttcggtgctagctgcttcatattgttagctatcgttatgggcctcgtgttcatctgcgtgaagaacggtaacatgcgttgcactatctgcata

SEQ ID NO: 546 - DNA, 1680 bp, Influenza A virus
  misc_feature (1)..(1680): Codon Optimized Sequence Encoding H7 Hemagglutinin
atgaacactcaaattctggtgttcgcactcattgccatcataccaactaacgctgacaagatatgcttgggccatcacgccgtgagcaatgggacaaaggtaaacaccctcacagaaagaggcgtcgaagtggttaatgctacagagacagtcgagaggacaaacatcccccgtatttgttccaagggtaagaaaactgttgatctgggccagtgtgggttgttaggaaccatcaccggacccccgcaatgtgatcaattcctggaattttctgcggatctgattattgagaggcgcgaaggcagcgatgtgtgttatcccggaaagtttgttaacgaagaagcactgcggcagattctgcgagaatccggtggcatcgacaaagaggctatgggctttacttattccggcatcaggacgaatggagccacctctgcctgccgccggtcagggagttccttctatgcagagatgaagtggctgctctccaatacagataatgccgcattccctcagatgacgaaatcttataaaaacacacggaagagtcccgcactgatcgtctggggaattcaccactccgtgagcactgcagagcaaaccaagctgtacgggtcagggaacaagttagtgacagtcggaagctctaattatcaacagtcgttcgtgccaagtcctggggcccgaccgcaggtgaatggtcagtcagggcgtatcgatttccactggttaatgctgaatccaaacgacaccgtgaccttctcctttaatggcgcctttattgcacccgatagagcttcctttttaagaggaaaatccatgggaattcaaagtggtgtgcaggtagatgcgaattgcgagggagattgttatcactccggtgggaccattatctccaacctccctttccagaacatcgactcgcgagctgtgggcaagtgcccaagatacgttaagcagagatcgcttctgttggccaccggaatgaagaacgttcctgaaattcctaagggccgcggattattcggcgccattgcaggctttatagaaaacggttgggagggccttatcgatggatggtatggcttcagacaccagaatgcacaaggggaggggactgccgccgactataagtcgacccagagcgcaattgatcagattactgggaagcttaatagactcatcgagaaaacaaaccaacagttcgaactcattgacaacgagtttaatgaggttgagaagcagatcggtaatgtcatcaactggacaagagacagcatcactgaggtgtggtcctataatgctgagctgctggtagctatggagaaccaacacacaattgatctcgccgactcagagatggacaagttgtacgagcgcgtcaagaggcaattaagagaaaacgccgaggaggatgggaccggctgttttgagatcttccataaatgcgatgatgactgtatggctagcatccgaaacaacacttatgaccactccaaatatcgggaagaagcaatgcagaatcgaattcaaattgacccagttaaactcagttccggatataaggacgttatcctctggttcagcttcggagcatcttgctttatactgctggcaatcgttatgggactcgtgttcatctgtgtcaagaacggtaacatgagatgtactatctgcatt

SEQ ID NO: 547 - DNA, 1680 bp, Influenza A virus
  misc_feature (1)..(1680): Codon Optimized Sequence Encoding H7 Hemagglutinin
atgaacacacaaatcttggtctttgctctcattgcaataataccgacaaatgccgataaaatctgtctaggacaccacgctgtatccaatggaacaaaggtcaataccttgacagagcgcggcgtagaggtggtaaatgccacagagacagtcgagcgaacaaatattccccgcatatgttccaaaggtaaaaagaccgttgacctcgggcagtgcggattactgggaacaatcacgggccccccacagtgtgaccaatttctggagttcagtgccgatttaatcatagagcgcagggaaggttccgacgtctgttatcctggcaagtttgtaaacgaggaggccttacggcaaatactgagggagtcaggcggcatcgagaaggaagccatgggcttcacctattccggaattcgggcgaacggcgcaacctcggcctgccgacggagcggaagctcattttacgccgagatgaagtggctgctttccaacactgacaacgcagctttccctcaaatgacaaagtcgtataagaacacaagaaaatctcctgccctcattgtttggggcatacaccattccgtgtcaacagcagaacagacaaaactctacggctcgggtaacaagctcgtgacagtcggttccagtaattaccagcagtcctttgtaccttcccccggtgcacggccccaggtgaacggcctctctggcaggattgatttccactggctgatgctgaatcctaacgatacagtcacttttagctttaatggagctttcattgcacccgaccgcgccagctttttgaggggaaaatccatggggatccaatccggagtgcaggtggatgctaactgcgaaggcgattgttatcatagtggggggaccataatcagtaacctcccttttcagaatatcgactcccgcgcagtaggaaaatgccctaggtacgtgaaacagcgctccttactgctcgccacgggcatgaagaatgttcctgagataccaaaagggcggggcctgtttggggctattgcgggattcattgaaaacgggtgggaggggttgatcgatggctggtacgggttcaggcaccagaatgcccagggtgaaggaacagcagccgactacaagtctacgcagtctgctatcgatcagattaccggcaagctaaaccgcttaattgaaaaaaccaaccaacagttcgaactgatcgacaatgagtttaacgaagtggaaaagcagatagggaacgtgattaattggaccagagacagtattaccgaggtgtggtcgtataatgccgaactgttggtagctatggagaaccagcacacgatagatctggcagacagtgaaatggataagctgtatgagagagtaaagcggcaactccgggaaaatgcagaagaggatggcacaggatgcttcgagatattccataagtgtgatgacgattgtatggccagcatcagaaacaatacctacgaccactcaaaataccgcgaagaggccatgcagaataggattcaaattgacccagtgaagctctcctcgggatacaaagatgtgatcttgtggttcagcttcggcgcctcctgttttatcctcctggcgatagtgatgggactcgtctttatttgcgttaagaacgggaacatgaggtgcaccatatgcatc

SEQ ID NO: 548 - DNA, 1680 bp, Influenza A virus
  misc_feature (1)..(1680): Codon Optimized Sequence Encoding H7 Hemagglutinin
atgaacacccagatcctagtgtttgcacttatcgccatcatcccgactaatgcggacaagatctgcctgggccatcacgctgtgtctaatggaaccaaggtgaatacgctgacggaacgaggagtggaggtggtaaatgctacggaaacagtcgagagaaccaacatcccacggatctgctctaagggaaaaaagaccgttgatctgggccaatgcggtctactcggtaccattaccggaccaccacaatgcgaccagtttctcgaattcagcgccgacttgatcatagaaaggcgcgagggatcggatgtgtgctaccctggcaaattcgtgaatgaggaggccctccgccagatccttagagaatcaggtggcatcgataaggaagctatgggcttcacatactcgggcataagaacaaatggcgctaccagcgcctgtcgacgctcgggcagctccttttatgccgagatgaagtggttgctcagtaacacagataacgcagccttcccacagatgacaaagtcttacaagaatacccgtaaaagcccagcccttattgtgtggggaatacaccatagcgtgagcacggcagagcagacgaaactgtatggtagcgggaacaaactcgttacggtcgggagctcaaactaccagcagtcttttgtaccttcacccggcgctcgcccacaggttaacggtcagtcggggagaatcgatttccactggctgatgctgaacccaaatgacaccgtcaccttctccttcaacggagccttcattgccccagatcgcgcctcttttcttagaggcaagtccatgggcatccaatcaggcgtccaggtcgatgccaattgtgaaggcgactgttatcattccggaggcacaattataagcaacctgcccttccagaacatcgacagtcgagctgtcggtaagtgccctcgttacgtgaagcagcggagtctcctcttagctacaggaatgaaaaatgtcccagagatccctaaaggacgcggtctctttggggccatagctggattcatcgaaaacggctgggaaggcctgatcgacggctggtacggcttcagacaccagaatgcacaaggggaaggaaccgctgctgattataagagtacccagtcagctatcgaccaaataaccggtaagcttaaccgactgattgagaaaacaaaccagcaatttgagctcattgataatgagtttaatgaggtggaaaagcagattggcaatgtcattaactggacccgcgactcgattacagaagtgtggtcttataacgcggagttacttgtcgccatggaaaatcagcacaccatcgacttggccgactctgaaatggacaaactgtacgagcgagtcaagcgacaactgagggagaacgccgaggaagacgggaccggttgttttgagatatttcacaaatgcgacgatgactgcatggcctcgatcaggaacaatacttacgaccactccaagtacagggaagaagcgatgcaaaacaggatacagatagatcctgttaagctctccagtgggtataaagacgtgatcctgtggttcagcttcggagcatcctgttttatccttttggccatcgtaatgggattagtcttcatctgcgtgaagaatgggaacatgcggtgcaccatctgtata

SEQ ID NO: 549 - DNA, 1680 bp, Influenza A virus
  misc_feature (1)..(1680): Codon Optimized Sequence Encoding H7 Hemagglutinin
atgaatacccagatattggtatttgccctgatagcgatcattccaactaacgcagataagatatgcctcggccaccacgctgtgtcgaatgggactaaggtgaataccctgactgaaagaggtgtcgaggtggtcaacgctaccgaaacagtggaaaggaccaacataccgagaatctgcagcaaaggtaaaaagactgtagacctcggccagtgcggccttctggggaccattactggacctccccaatgcgatcagttcctggagttctctgccgacctcatcattgagcggagagagggaagcgatgtgtgctaccccggcaaatttgtgaatgaggaggctctgagacagattttgagggagagtggcgggatcgaaaaggaggcaatggggtttacctactcaggaatcagggccaacggagcaacctctgcatgcagaaggtccgggtcctccttctacgcagagatgaaatggctgttaagcaatacggataatgccgccttccctcagatgactaagtcctataaaaatacccgtaagagtccagcactcatagtctggggcattcaccattccgtctctacagcagagcagactaaactctatggaagcgggaacaaactcgtgaccgtcggctcgagcaactatcaacaatctttcgttccatctcccggagccagaccccaggtgaacgggctatcgggacggatcgacttccactggctgatgttaaaccccaatgatacggtcacctttagcttcaatggtgcattcatcgctccagaccgggcctcgtttctcagaggaaaatctatgggaatccagagtggtgtgcaggtggacgccaactgcgagggtgattgttatcattctgggggcactatcatctcaaacctcccattccagaacatagattcaagagcagttggaaagtgtccaagatatgtgaagcagcgctctctgcttttggccaccggcatgaaaaatgttcctgagataccgaaaggacggggcctatttggcgcgatcgcaggattcatcgaaaatggatgggagggactgatcgacggttggtatggcttccgccaccagaatgcccagggggaaggtaccgcagctgactataaatcaacgcagtccgccatcgatcagataactggcaaactgaataggctaatagaaaagactaaccagcagtttgagctgattgacaatgaattcaacgaagtggagaagcagattggcaacgttattaactggacccgggactccatcacggaggtgtggtcttacaacgcagagttactagtagcaatggagaatcagcacactatagacctagccgatagtgaaatggacaaactatatgagagagtcaaacgccaactgcgggagaacgccgaagaagatggaacaggatgtttcgagattttccacaaatgtgatgatgattgcatggcgtctatccgcaataatacttacgatcattcaaagtaccgcgaagaggccatgcagaaccgaatccagattgatcccgtgaagctttcctccggatacaaagatgtaatcctgtggttctcattcggcgcttcctgtttcatcttactggcaatcgtcatggggctggttttcatttgcgtcaaaaacggcaatatgagatgtactatttgcatc

SEQ ID NO: 550 - DNA, 1680 bp, Influenza A virus
  misc_feature (1)..(1680): Codon Optimized Sequence Encoding H7 Hemagglutinin
atgaacacccagatcctggtttttgccttgatcgcaattattcctaccaatgcggacaaaatttgccttgggcaccacgccgtttccaatggcacaaaggtcaacactttgaccgaacggggagtggaagtggtgaacgctacagaaaccgttgagcggactaacattcccaggatctgtagtaagggcaagcgcaccgtggacctgggccagtgcggattgttaggcaccatcaccggcccaccccagtgcgaccagttcctggaatttagtgcagatttaatcatagaacgaagagagggttctgatgtgtgttacccggggaaattcgtgaacgaagaggccctccgccagattttgagagagagcggaggcatagataaagaagcaatgggctttacctatagcgggatccggactaatggagctacctctgcatgtcggcgtagtggaagttctttctatgctgagatgaaatggctcctttctaacacagacaatgctgcatttccacaaatgacaaaatcctataaaaatactcggaaatccccagccctgatcgtttggggaatccaccattcagtttcgactgcagaacagactaaattgtatgggtccgggtctaagctggtaacagttggaagttccaattaccagcaaagcttcgtcccctcgccaggtgcacgcccacaggtgaacgggctaagcgggcgtattgatttccactggttaatgctgaatccaaacgacactgtcacgttcagctttaacggagcgttcatcgctcctgaccgcgccagtttcctgcgaggtaaatcaatgggcatccagtcaggtgttcaggtagatgccaactgtgagggggattgctatcattctggggggactattattagtaacctgcccttccagaatatagattctcgggccgtcggcaagtgtccaaggtacgttaaacagcgcagtctgttacttgccactggaatgaagaacgttcccgagatcccaaagggccgaggtctgttcggggccatcgccggctttatcgagaatggatgggaagggttgattgatggatggtatggtttccgtcaccaaaatgcccagggagaggggacagctgctgactataagtccacccagagtgcaatagaccaaatcacagggaaactgaatagacttatcgaaaagaccaaccagcagtttgagttgattgataacgaattcaatgaagtcgagaaacagattgggaatgtcattaattggacacgagactccatcacagaggtgtggtcctacaatgccgaattgttggtggccatggagaatcaacatactatcgatctggcagactcagaaatggacaagctgtatgagcgagtgaagaggcagctgagagagaacgccgaagaagatggaaccgggtgctttgagatttttcataagtgtgacgacgattgtatggcaagtatccgcaataatacctacgaccactccaagtatagagaggaagccatgcagaaccggattcagattgatccagtgaaactcagttccggctataaagacgtgatcctgtggtttagcttcggcgcctcctgtttcatcctgttggccattgtcatggggctggtctttatctgtgtcaagtcccgaaacatgcgatgcacaatctgcatc

SEQ ID NO: 551 - DNA, 1680 bp, Influenza A virus
  misc_feature (1)..(1680): Codon Optimized Sequence Encoding H7 Hemagglutinin
atgaacactcaaattctagtgttcgcactgattgccattatcccaactaacgccgacaaaatctgtttgggccaccatgctgttagcaacggtaccaaagtgaataccctgaccgaaagaggcgttgaagtagtaaacgccactgaaaccgttgagaggacaaacattccacggatttgtagcaaaggaaagaaaactgtcgatctggggcaatgtggactgctgggcaccatcactggccctccccagtgtgaccagtttctggagttttccgcagatttaatcatagagcgcagagaaggaagtgacgtgtgctaccctgggaaattcgttaatgaagaagccctccggcagatcctaagagaatctgggggtatcgaaaaggaggcaatgggattcacgtactcggggatccgtgctaacggagcaacttccgcatgccggaggtcagggtcatctttttatgctgaaatgaaatggttgctgtcaaataccgataacgccgcgttcccgcaaatgacaaagagctacaaaaatacccgcaagagtcccgcgctcatcgtgtggggcatccatcatagcgtgtccactgctgagcagaccaaactttatggtagtgggaacaagctggtcacggtcggatcaagcaattaccagcagtccttcgtaccaagcccgggggcccggccccaggtgaacggcctgtcaggacgcatcgactttcactggttgatgttgaacccgaatgatacagtgactttttcattcaacggcgcttttatcgcaccagacagggcctcctttctccgcgggaagagcatgggcatccagagtggtgtgcaggttgacgcgaattgcgagggagactgttatcactcaggcggaacaattatcagcaatcttcctttccaaaacattgattcgagagccgtcgggaagtgccccaggtacgtcaagcagcgaagtctgcttttagctacaggaatgaagaacgtgcccgagatacccaaaggcaggggactgttcggcgcaatcgctggctttattgagaacggatgggaaggtctgatcgatggctggtatggatttaggcaccagaacgctcagggcgagggcactgcagccgattataagagcacgcagtctgccatagaccaaatcaccgggaaactcaacaggctgatcgagaagaccaaccagcaatttgagctcattgacaatgaatttaatgaagtggagaagcagatcggcaatgttattaattggacacgagactctattactgaagtgtggtcttacaatgccgagctgcttgttgcaatggagaatcagcatacaatcgatctggccgattcagagatggacaagctgtacgaaagggtgaaacggcagctacgggagaacgctgaggaggatggcacagggtgctttgagattttccataagtgcgacgacgattgtatggcgagtatacgcaataacacctacgatcattcaaagtatcgcgaggaagccatgcagaaccgcattcagatcgatcccgtgaagttgtcctctggctacaaagacgtcattctgtggttcagctttggagcatcctgtttcatcctcctggcaatcgtgatgggactcgtgtttatctgcgtcaaaaacggcaatatgaggtgcaccatctgtatt

SEQ ID NO: 552 - DNA, 1680 bp, Influenza A virus
  misc_feature (1)..(1680): Codon Optimized Sequence Encoding H7 Hemagglutinin
atgaatacacagatcttggttttcgctctgatcgccatcataccgaccaatgctgacaaaatctgtctgggtcaccatgcagtgagcaacggtaccaaagtcaatacattgaccgagcgtggcgtcgaagttgttaatgccacagaaacagtcgagcgaaccaatattccgagaatttgctccaaggggaagaagaccgtggacctaggccagtgtggactgctgggtacaattactgggccaccacagtgtgatcagttcctggagttcagcgcagatctgatcatcgaacggagagagggatcagatgtatgctatcctggtaaattcgtaaacgaagaggccctgcgacagattctaagaaaaagcggaggcatcgataaggaagctatggggttcacatattcaggcatcagaactaatggtgccacttccacttgccgacgaagcgggagtagcttctacgcagaaatgaaatggcttctatcaaacacggacaacgcggcctttcctcagatgaccaaatcctataagaacaccagaaaaagccccgcaatcatcgtatggggaattcatcactctgtgagtaccgccgagcagacaaagctttacggctccggaaacaagctggtgaccgttgggagtagcaattaccagcagtctttcgtaccatcccccggtgcgagaccccaagttaacggcctttcaggacgcattgatttccactggctgatgttgaatccgaacgacaccgtgacgttctccttcaacggggcattcattgcacccgatagagcctgtttcctcaggggaaaatccatgggcatacagagcggggtgcaggtggacgccgactgtgagggagactgctaccactctggtggtacgatcataagcaacctcccattccagaatatcgattctagggcggtgggtaaatgtccaagatatgtgaagcagcggtctcttctgctggccaccggcatgaaaaacgttcctgagattcccaaaggcagagggctgttcggcgcaatcgccggctttatagaaaacggatgggagggcctgatcgatgggtggtacggattcagacaccagaatgcccagggcgaaggtacagctgcagattacaaaagcacacagtcagccattgaccaaatcacaggcaaactgaatcgcctcattgagaaaacgaatcagcagttcgagctcattgataacgagttcaacgaggtcgaaagacaaattggtaatgtgatcaactggacgagggactcaatcactgaggtgtggtcttataatgcagagctgttggtggctatggagaatcaacacacaattgacctggcggattctgaaatggataaactgtacgaacgagtcaagcgtcagctgagggagaacgctgaggaagacgggactggatgcttcgaaattttccataaatgcgatgacgattgcatggcctctatccgaaacaatacatacgatcatagtaagtacagagaagaggccatgcagaacagaatccagattgacccggtgaaactgtcatcgggatacaaggacgtcatcctctggttttcttttggtgcctcttgcttcatattactggcaattgttatgggactggtcttcatatgtgttaagaatggtaacatgcggtgtacaatatgcatc

SEQ ID NO: 553 - DNA, 1680 bp, Influenza A virus
  misc_feature (1)..(1680): Codon Optimized Sequence Encoding H7 Hemagglutinin
atgaacactcaaatcctcgttttcgctctgattgctattattcctactaatgccgataagatttgtctgggccaccatgcagtttccaatggaaccaaggttaacaccctgacggagcgtggtgttgaggtggttaatgcaactgaaactgttgagcgtaccaatatccctagaatatgcagtaaggggaaaaaaactgtggacctcggccaatgtggcctgctgggcaccatcacagggccgccccaatgtgatcaatttttagaatttagcgcagacctgattatcgagcgccgagaaggtagcgacgtgtgctaccctggcaagtttgtgaatgaggaagccctgagacaaattcttagggagtcaggaggcatcgacaaggaagccatgggctttacctatagcgggatcagaacaaatggcgcaacttcagcctgtaggcgctcggggtcctctttctacgcagagatgaaatggctgctcagcaatacagacaatgctgctttccctcagatgaccaagtcctacaaaaatacccggaagtcgcccgctttgatcgtttggggaattcaccattctgtcagcacggccgagcagactaagctatacgggtccggtaacaaactggtgacagtcggcagcagcaattaccagcagtctttcgtgccctccccaggcgcaaggccccaggtaaatggtcagtctggacgcatagattttcactggctcatgctcaaccccaatgacacagttaccttttccttcaatggagcctttatcgccccggatcgcgccagttttctgcggggtaaatccatggggatccagtcaggggtgcaggtcgacgctaactgcgagggagattgttaccactcaggaggaaccatcatcagcaatttgcccttccagaatatcgattctagggcagtgggcaagtgtccaaggtacgtaaagcagcgatccctcctgctggccaccggtatgaaaaatgtgccagagatccctaaaggtagggggctcttcggggctatcgcgggcttcatcgagaatgggtgggagggactcatcgatggatggtacggcttcagacaccagaacgcacaaggcgaggggacagcagctgattataaatccacccagtccgctatcgaccagattacagggaaactgaatcggctcatcgagaagaccaaccagcagttcgagctgattgacaatgagttcaatgaggttgaaaagcagattggcaacgtcatcaattggactcgtgacagcatcaccgaggtttggtcctacaacgccgagctgctcgtcgccatggagaatcaacacactatagacttggccgactcagaaatggataagctatatgagagagttaagcgacagttacgcgagaacgcagaagaagacggtaccggatgctttgaaatctttcacaaatgcgacgacgactgtatggcatcaataagaaacaacacctacgatcactcaaagtaccgcgaggaggccatgcaaaaccggatccaaatagaccccgttaagttgtccagcgggtataaggacgtgattttgtggttctcttttggggcctcctgtttcattcttctggctatcgtgatgggcctggtgttcatatgtgttaagaatggtaacatgagatgtactatctgtatt

SEQ ID NO: 554 - DNA, 1680 bp, Influenza A virus
  misc_feature (1)..(1680): Codon Optimized Sequence Encoding H7 Hemagglutinin
atgaatacacaaattctggtcttcgctctgatcgccataattcccaccaacgctgataagatctgtctgggccaccacgccgtctccaatggtactaaagtaaacactctcactgagcgcggcgttgaagtggtcaatgctaccgagactgtggagcggacaaacatcccaaggatttgctctaagggaaagagaactgtggacttgggccagtgtggattactgggcacaattacaggccctccccagtgcgatcagttcttggagtttagtgccgacctaataattgaacgcagagagggatctgacgtgtgctatccagggaaatttgttaatgaagaggcactccgccagattctgcgagagtccggcgggatcgacaaagaggccatgggattcacgtattcgggcatcaggaccaatggcgcgacctccgcgtgtcgacggagcggcagtagcttttatgctgagatgaagtggctcctcagtaacaccgacaacgctgctttccctcagatgaccaagtcatacaagaatacccggaaatcccctgcacttatcgtgtggggaatccatcattccgttagtaccgccgagcaaactaaactgtacgggagtggcaacaagcttgtgactgtgggctcatcgaattatcaacagtcgttcgtcccatcaccaggcgctaggccacaggttaatggactgtcggggcgcatcgattttcactggttaatgttaaaccctaatgacaccgttacgtttagcttcaatggtgcctttatcgcccccgaccgggccagcttcctccgtggaaagtccatgggaattcagtcaggcgtacaagtggatgccaactgtgaaggcgattgctaccattctggaggaaccattattagcaacctgcccttccagaacattgatagcagggcagtaggtaaatgtccccggtatgtgaaacaaagaagcctgctgctcgccactggcatgaaaaacgtccctgagatcccgaaaggtagaggcttgttcggggcaattgccgggttcattgaaaacggatgggaaggactgattgacggatggtatgggttccggcaccaaaatgctcagggagaagggaccgcagccgattataagtcaacccaaagcgccattgaccagattaccggaaagcttaaccggctcatcgaaaagacaaatcagcagtttgagctgatcgacaacgaatttaatgaggtggagaagcagatcggaaacgtgattaattggactagggacagcatcaccgaggtctggtcttataacgccgaactgctggtagcgatggaaaatcaacacaccatcgacctggctgactcagagatggataagctgtatgaaagggtcaaacgtcagcttcgtgaaaatgctgaagaggatggcacaggttgcttcgaaatcttccataagtgtgatgatgattgtatggctagtattaggaacaacacatacgaccattccaaatatcgggaggaagctatgcaaaaccggatccaaatcgacccagttaaactgtcttccggctacaaagatgttattctctggttcagttttggtgcatcctgctttatactccttgccatcgtaatgggcctggtgtttatctgcgtcaagaacggaaacatgcgatgcacgatctgtatc

SEQ ID NO: 555 - DNA, 1680 bp, Influenza A virus
  misc_feature (1)..(1680): Codon Optimized Sequence Encoding H7 Hemagglutinin
atgaacactcagatcctcgtattcgccttgatcgctattattccaactaacgccgataaaatctgccttggccaccatgccgttagcaacggtactaaagtgaatactcttacagagaggggcgtcgaggtcgtaaatgccactgaaacagttgagcgaacaaacattcctcgaatttgttctaagggaaaaagaacagtcgacctcggccagtgcggattgctgggaaccattacggggcctccccagtgcgatcagtttctggagttttccgccgacctgatcatagagcggcgcgagggttccgacgtgtgctacccaggaaaatttgtcaacgaagaagcactacgacagatcttgagagagagcggagggattgacaaggaagcaatgggattcacttatagcggcatcaggactaatggtgcgacctctgcttgcagacgttccgggtcatccttctacgcagagatgaagtggttactaagcaataccgataacgcagcttttccccagatgaccaagtcctacaagaatacacggaaaagccccgctttgatcgtttggggtatccatcactctgtgagcaccgcagaacagacaaagttgtacggatcgggaagtaagcttgtcaccgtgggctcgtccaactaccaacagtcttttgtaccttctccaggggctcgtccacaagtcaacggcctgtctgggagaatcgactttcactggctcatgttaaatcccaatgacacagtcaccttctcctttaatggcgccttcattgcacccgaccgtgcctcattcctgagaggtaagtccatgggaattcagagcggtgtccaggtcgacgctaactgcgagggggactgctatcactccggggggacaattatcagtaatttgccctttcagaatattgattcaagagctgttggaaagtgcccacgctacgtaaagcagagaagcctcctattggccacaggaatgaagaacgtgccggagatccccaagggtcgcggtttgtttggcgccatcgctggctttattgaaaacggatgggagggtttgattgatggctggtatgggttcaggcatcagaacgcccagggagaaggtaccgcagcagactacaagagcacacagtccgccattgaccagattactggtaagctgaacagattgatcgaaaagactaaccagcagtttgagctgattgacaatgaattcaacgaagtggaaaagcagatcgggaatgtgatcaattggacccgggattcaatcaccgaggtgtggagctataatgccgagctgctcgtagccatggagaatcaacatacaatagatctcgctgactccgaaatggataagctctacgagcgcgtaaaacggcagctgcgcgaaaacgctgaagaagatggaactggatgcttcgagatctttcataagtgcgacgatgattgtatggcctccattagaaataatacctatgaccatagcaagtacagggaagaggccatgcaaaatagaatccagatcgatcccgtcaaactaagttcggggtataaggatgtgatcctatggttttcctttggtgctagctgtttcattctgttagccatcgtcatggggcttgtgttcatatgtgtgaaaaatggtaacatgcggtgcacaatttgtata

SEQ ID NO: 556 - DNA, 1680 bp, Influenza A virus
  misc_feature (1)..(1680): Codon Optimized Sequence Encoding H7 Hemagglutinin
atgaatacacagatcttagtatttgcgctaatcgctattatccctaccaatgctgataagatctgtctgggccaccacgccgtttccaatggcactaaagtgaacactctcactgagcgcggcgtcgaggtggtcaacgccaccgagacagttgagagaacaaacatacctcgcatctgtagtaaaggcaagaagactgtcgatctgggccagtgtgggctgctgggaacgataaccggtccccctcagtgtgatcagtttctggaattctctgcagacctgattatcgaaagacgagaagggagcgacgtgtgttaccccggaaagtttgttaatgaggaagcactgcgccagatccttcgggaatctgggggcatcgataaggaagcgatgggcttcacttatagtgggattcgcaccaacggggctacgtccgcttgccggcggagcggttcgtctttttacgcggaaatgaagtggctgctcagcaataccgataacgccgccttcccgcagatgacaaaaagctataagaatacccggaaaagtccggcactcatagtgtgggggatccaccatagcgttagcacggcggagcagacaaagctctatgggagtggaaataagctggtgaccgtcggctcttcaaattaccagcaatcatttgtgccctctcccggcgcccgtcctcaagtgaacggacagtcaggaaggattgacttccactggctcatgttgaaccctaatgacacagtgacattttcgtttaacggagcattcatcgcccctgacagagctagtttcctcagagggaagagtatggggatccagagcggggtacaggtggatgcaaactgtgagggggactgctatcattctggtgggaccatcatttcgaacctgccattccagaacattgactctcgcgctgttggcaaatgtcctaggtacgttaagcaaagatcattgctgctcgcaacgggcatgaaaaacgtgccggaaatccctaaaggtcggggtctcttcggcgccatcgccggattcattgagaatggctgggagggactcatcgacgggtggtatgggttccggcatcagaacgcacagggcgaggggactgccgctgactacaaatcgacccagtccgctattgaccagatcaccggcaaactcaaccggctgatcgagaagactaaccaacagtttgaactcatcgataatgagttcaacgaggtagaaaaacaaattggaaacgtgatcaattggacacgcgattctattactgaggtctggagttataacgcagagctgctggtggctatggaaaaccagcacaccattgatctagctgactcggaaatggataagctgtacgaaagggtgaaacgccagctacgcgaaaatgccgaggaagacggtacaggatgcttcgagatattccacaagtgcgacgacgactgcatggccagcatccgcaataacacatatgaccattctaaataccgggaggaagccatgcagaatcgaatccagatcgaccctgtcaaattaagcagtgggtacaaggacgtgatcctgtggtttagcttcggagctagttgttttatattactcgccatcgttatgggattggtatttatctgcgtcaagaatggaaacatgcgctgcactatctgcatc

SEQ ID NO: 557 - DNA, 1680 bp, Influenza A virus
  misc_feature (1)..(1680): Codon Optimized Sequence Encoding H7 Hemagglutinin
atgaacacccagatactcgtctttgccctcattgccataatcccgactaatgcggataagatttgtctagggcatcacgctgtatcaaacggcacgaaagtcaacaccttgaccgaaaggggcgtagaggtggtaaacgctacagaaacagtcgagcggacaaatatcccaaggatttgcagcaagggtaaaaagactgtagacttaggacagtgcggcttactcggcacaatcacaggccccccccaatgtgatcagttccttgaattcagtgcagatctgataatcgaaaggagggagggatctgacgtgtgttacccaggcaaattcgtcaacgaggaagcactcagacagatcttaagaaagtccggcgggatagacaaagaagctatgggttttacgtacagtgggataagaaccaatggcgccactagcacctgtaggaggagtgggtcgtccttctatgctgaaatgaagtggctgctgtccaatactgacaatgcagcctttcctcagatgacaaagagctacaagaatacaaggaaaagcccggcaattatagtatggggaatccaccattcagtcagcaccgctgaacaaactaagctgtatggctccggcaataagctcgtcacagtggggagctcaaattatcagcagtcattcgtgccaagcccaggggcgcggccgcaagttaacggcctctccggaagaattgattttcattggttaatgcttaatcctaacgacacggttaccttcagctttaacggcgctttcatcgctcccgacagggcttgttttctccgcggcaagtctatgggaatccagtccggggtgcaggtcgacgcggattgtgaaggagactgctaccacagtgggggcactataatctcaaatctgccattccagaatatcgacagtcgcgccgtggggaagtgtccgagatacgttaagcaacgatcactgctactggccaccggtatgaaaaatgtgccagagattcccaaagggagaggcctgtttggtgccatcgccgggtttatcgagaacgggtgggaaggcttgattgacggctggtacggatttcggcaccaaaacgcccaaggggaaggtaccgctgccgattacaagagcacccaaagtgccattgaccagattacggggaaactgaacagactgatcgagaaaacgaatcaacaattcgaactgatagataacgaatttaacgaagtcgagcgacagatcgggaatgtgatcaactggactagggattctattaccgaggtatggagctataatgctgagcttcttgtggcaatggaaaatcaacacacaatagatttagcggatagtgagatggacaagctctacgaacgggtaaaaagacagttgagagagaatgccgaggaggacgggacaggctgttttgaaatcttccataagtgtgacgatgattgtatggcgagcatccgaaacaatacttacgatcacagcaaataccgtgaggaggcgatgcagaatagaatccagatagatccggttaaactgtccagcgggtacaaggatgtgatcctgtggttctcattcggcgcttcatgtttcattttgctggcaattgtgatgggactcgtgttcatatgtgtgaaaaacggcaatatgcgctgcactatttgcatc

SEQ ID NO: 558 - DNA, 1680 bp, Influenza A virus
  misc_feature (1)..(1680): Codon Optimized Sequence Encoding H7 Hemagglutinin
atgaatacacagatcctagtgttcgcactcatagctataatccctacaaatgccgacaagatatgtcttggccaccacgctgtgtcaaacgggacaaaagttaacaccttgacagagcggggcgtcgaggtcgttaacgccaccgagactgtggaaagaacaaatataccccggatttgttcaaaagggaagagaactgtcgacctggggcagtgcggactcctggggactatcactggacctccacaatgcgaccagttcctcgagttctctgccgatctcatcattgagaggcgagaggggtccgatgtgtgttacccagggaaatttgtgaatgaggaagcccttcggcagatacttcgtgaaagcgggggcatcgataaagaggccatgggttttacgtattctggaattcgcaccaacggggccacaagtgcatgtcggaggagcggatcatcattctatgcagagatgaaatggctgctttctaacaccgataatgccgctttcccgcagatgacaaaaagttataaaaataccaggaaatcccccgctctaattgtgtgggggattcatcacagcgtttccactgccgaacagactaagctgtacggttcgggcagcaagctggtgacagtgggttcatcaaactaccaacagtccttcgtgccttctccaggcgcgcggccgcaggttaacggactctctggcagaatcgactttcattggttgatgctgaatcccaacgacaccgtcaccttctcctttaacggtgcatttatcgccccagatcgtgcttcatttctacgcggcaaaagcatggggattcagtccggcgtccaggtagatgcaaactgtgagggcgactgttaccactcaggcggaacaattattagcaacctgccatttcagaatattgactctcgcgccgtggggaaatgcccaagatatgtcaagcagcggagcctgctcctggccactgggatgaagaatgtgccagaaataccaaagggtagaggtctgttcggcgccatcgctggctttatagagaatggatgggagggactgatcgatggctggtacggattcagacatcaaaacgcccaaggtgaaggaaccgctgccgattacaagtctacccaaagtgctatagatcagataaccggcaagcttaataggctcattgagaaaacaaatcagcagttcgagctgatcgacaacgagttcaacgaggtggagaagcagattggaaacgtgattaattggacgcgcgatagcatcacagaggtgtggtcctataacgcagagctgctggtggctatggagaaccagcacactatcgatctggccgactccgaaatggacaagctgtacgagagggtgaagcggcagttgcgagagaatgccgaggaggacgggacaggctgctttgagatctttcacaagtgcgacgatgattgtatggcttcaatccgcaataacacatacgatcattccaaatacagggaggaagctatgcagaaccgaatccagatagatccagtgaagctctctagtggctacaaggacgtgattctgtggttcagtttcggtgctagctgttttattctgcttgcaatagtaatggggttggtgtttatctgtgttaagtcacggaacatgcgctgcaccatatgcatc

SEQ ID NO: 559 - DNA, 1680 bp, Influenza A virus
  misc_feature (1)..(1680): Codon Optimized Sequence Encoding H7 Hemagglutinin
atgaacacacagatcctagttttcgcgctgatcgcaatcatacctacaaatgctgacaagatttgcctaggacatcacgccgtgtctaatggaaccaaagtaaacactctgactgagcgcggggtagaggtcgtgaatgcaacagaaacggtagagcggacaaatatccctaggatatgcagtaaaggcaagcgtacagtagatctcggccagtgtggcctactcggaacaatcaccggtcctccccagtgcgaccagttccttgaattcagtgctgatctgatcattgaaaggcgggaggggtccgatgtatgttaccctgggaagtttgtcaatgaagaggcactgcgccaaatcctgagagagtcaggaggcatagacaaagaggctatgggatttacatacagtgggataagaactaacggcgcgaccagcgcctgcaggaggtccgggtcgtctttctatgccgaaatgaaatggctcctttctaatacagataacgcagcctttccccagatcactaaatcatacaagaatactaggaagtcacccgcactcatcgtttggggcatacatcactcggtcagcaccgccgaacagactaaattatacggttcagggaacaagctcgtaaccgtgggctcgtctaactatcaacagagtttcgttccgtcccccggggcgagaccgcaggtgaatggcctctccgggcgaatcgattttcattggctgatgctgaaccccaacgataccgtaaccttttcgttcaacggggctttcatcgctccggatagagcatcatttctgcgcgggaagtccatgggcattcagagcggtgttcaagtcgacgccaactgtgagggagactgttatcacagcggggggaccatcatcagcaacctcccgtttcagaatattgactcaagggcggtcggaaagtgtccacgttacgtcaagcagcggagtctcctgttagcgacaggcatgaagaatgtccctgaaattcctaaaggccggggcctatttggtgccatcgccggtttcatcgagaacgggtgggaaggtctgatcgatggttggtatggcttccgccaccagaatgcgcaaggggaaggaaccgcggcggactacaaaagtactcagtccgcaatcgatcagatcacaggtaagttgaataggcttatcgagaagacaaaccagcagtttgagcttatagacaacgaattcaatgaggtggaaaagcaaattggaaatgtaatcaattggaccagggatagcatcaccgaagtgtggagctacaatgccgagctgttggtggcaatggagaaccaacatacaatcgacctagccgatagtgagatggacaagctgtatgagcgggtgaagcggcagctgagggaaaatgcggaggaagacggaactgggtgtttcgagattttccacaagtgtgatgacgattgtatggcctcaattcggaacaacacatacgatcattccaagtatcgagaagaggccatgcaaaaccggattcagattgaccccgtcaagttatcctccgggtacaaggacgttattctctggtttagctttggagccagttgcttcattctgttggcaattgtgatgggtcttgtattcatctgtgtgaaaaatgggaatatgcgctgcaccatctgtatc

SEQ ID NO: 560 - DNA, 1680 bp, Influenza A virus
  misc_feature (1)..(1680): Codon Optimized Sequence Encoding H7 Hemagglutinin
atgaacacgcaaatcttggtgttcgcactgatcgccattattccaaccaatgctgacaagatttgccttggtcaccacgcggttagcaacgggaccaaagtgaacaccctgaccgagcgaggggtggaggtagtgaacgcaaccgagacagtggagagaactaatataccccggatctgtagcaagggtaagagaacggtggatcttgggcagtgtggcttgttggggactatcacaggccctcctcagtgcgaccagttcttggaattttctgccgaccttatcattgagcgcagagaggggtcagatgtctgttatcctggaaaatttgtgaacgaagaggctcttcggcagatactgcgcgaatcaggcggcattgacaaagaagccatggggtttacctatagcggaatcaggactaacggcgccacctccgcctgcaggaggagtgggagcagcttctacgctgaaatgaagtggttgctctctaacacagacaatgctgcattccctcagattaccaagagttataagaacacacgcaaatctcccgcgctgatcgtgtggggcattcatcacagcgttagcacggccgagcagacaaaactgtacggctcgggaaataaacttgtgacggttggcagcagcaactatcagcagtccttcgttccttctccaggcgcgcgcccccaggtgaatgggttgtctgggagaatcgactttcactggctaatgcttaatcctaacgacacggtgactttctcatttaacggagctttcatcgcaccagaccgcgcatcctttctgagagggaaatcgatgggcatccaatccggggtgcaggtcgatgcgaactgcgagggtgattgttatcactccgggggcaccataatcagcaacctgcctttccagaatatcgactcccgggcagtaggaaagtgcccacgatatgtgaagcagaggagcttgctgctggctacaggcatgaagaatgtcccagaaatccccaaggggagaggtctatttggggccatcgctggctttatagagaacgggtgggaaggtctgattgacgggtggtacggctttaggcaccagaacgcccagggcgaaggaacagctgccgactataaatctacacagagcgccattgatcagataactggcaagttaaaccggctcatcgagaagactaatcagcaatttgagcttatcgataacgaattcaatgaagtagagaaacaaatcgggaatgtgatcaactggactcgagattcaataacggaggtatggtcctacaacgccgaactgctcgttgctatggagaaccagcacaccatcgatctggcagacagcgagatggataagctctacgagagagtcaagcgacagttacgtgaaaatgccgaagaagatggaaccggttgctttgagatatttcataaatgcgatgatgattgcatggcttcgattcggaataacacatatgaccacagcaagtacagggaagaagcgatgcaaaaccgcattcagatcgacccagtcaaactaagctctggatacaaagacgttatactgtggttctcctttggagccagctgcttcatcctgctcgccatagtgatgggactggtgtttatctgcgtgaaaaacggaaacatgaggtgtaccatttgtatc

SEQ ID NO: 561 - DNA, 1680 bp, Influenza A virus
  misc_feature (1)..(1680): Codon Optimized Sequence Encoding H7 Hemagglutinin
atgaacacacagattctcgtcttcgcactcattgccatcatccctacaaacgcggacaaaatttgccttgggcaccacgccgtgagcaacggcacaaaagtcaacacattgacagagcgaggcgtagaggtcgttaatgccaccgaaacggtagaaaggacgaacattcctaggatatgtagtaaaggaaagcgtactgtagatttaggacagtgtggcttgctgggaactatcacaggacccccacaatgcgaccagttcctagagtttagcgccgatctgataattgaacgtagggagggaagcgacgtatgctacccagggaaatttgtgaaggaggaggccctccgacagattctgagagagtccgggggaatcgacaaggaagccatgggattcacctattcgggcataagaaccaacggcgcaacatccgcttgccggaggtccgggagtagtttttatgctgagatgaagtggctgctttccaacaccgataacgccgcctttcctcagatgacgaaatcctataagaatacaagaaaaagcccggcactcatcgtgtggggcatccatcacagcgtctccacggcagagcagactaaactctacggatctggaaataaactggtaacagtggggtcaagtaactaccaacagtcgttcgtgccatcccctggcgctcggcctcaggttaacgggctgtccggtaggattgatttccattggctgatgttaaacccaaacgacaccgtgaccttcagttttaacggcgcttttattgctcccgacagggcaagtttcttgaggggcaagagcatgggaatccagtctggtgtgcaggtcgatgccaactgtgagggagattgttatcatagcggaggtacgattatctctaatctaccttttcaaaatatcgactccagggcggtcgggaaatgtcctcgctacgtcaagcagaggtcactgcttctggcaaccggaatgaagaacgtgcccgaaatcccaaagggcagaggtctgtttggcgctatagccgggttcattgagaacggatgggagggtttaatagacgggtggtatggattccgccaccaaaatgcccagggggaagggacagctgccgattacaagtcaacacagagcgcgatcgatcagatcacaggaaagttgaacaggttgatagagaaaacaaatcaacagtttgagctgatcgataatgagttcaatgaggtcgagaagcaaattgggaacgtaataaattggacacgagattccataactgaagtgtggtcttacaatgctgaactgctcgtggcgatggaaaaccaacacacgattgatttggccgattccgagatggataaactgtatgaacgtgtgaagcgtcaacttcgtgaaaatgccgaagaggacggtaccggatgcttcgagatcttccacaagtgtgatgatgattgcatggccagtatcaggaataacacatatgaccattccaaataccgcgaagaggccatgcagaatcgtattcagattgaccccgttaagctgagttccggttacaaagatgtcattctctggttttcttttggcgcctcatgtttcattctgctagccattgtgatggggcttgtctttatctgtgtcaagaacggtaacatgaggtgtaccatctgtatc

SEQ ID NO: 562 - DNA, 1680 bp, Influenza A virus
  misc_feature (1)..(1680): Codon Optimized Sequence Encoding H7 Hemagglutinin
atgaatacccagattctggtgttcgcgttaatagccattatcccaactaacgctgataagatatgtctgggccatcacgctgtgagcaatggaactaaggtgaacactctgaccgagaggggtgtggaggtagtgaatgctaccgagacagtagagcggactaacattcccaggatttgctctaagggcaagcgcaccgtcgacctgggacagtgcgggttgctaggtacgataactggtccaccacaatgtgatcaattcttggaattttctgctgacctcattatagagaggagggagggctccgatgtgtgctaccccgggaaattcgtcaacgaagaagcactgcgtcagattttgagagaatcggggggtattgacaaggaggccatgggttttacctactccggcattcgtactaacggagccaccagtgcctgcaggcggagcgggagtagcttctacgctgagatgaaatggcttctaagcaacactgataacgccgctttcccccagatgactaaatcttacaaaaacacacggaagagtcccgctctgatagtatggggaatacaccattcagtctctacagccgagcagactaagctttatggaagcgggaacaaactggtgaccgtcggttcatctaattaccagcagtctttcgtgccctctcctggggccaggccccaggtgaatgggctgtctggccgcattgatttccactggttaatgctgaatcccaatgataccgtgaccttttctttcaatggcgctttcattgctcctgatagagcctcatttctgagagggaagtcgatggggatacagtctggggtccaggtcgacgctaattgcgaaggcgattgctaccactctggggggacaattataagtaatttgccgttccagaatatcgatagtagagctgtggggaaatgcccccgctacgtaaagcagcgttcccttttgcttgccacaggtatgaaaaacgtgcccgaaattccaaaaggaagaggactatttggtgccattgcggggttcatcgaaaacggatgggagggcctgatcgatgggtggtacggcttcagacatcaaaatgctcagggggaaggaactgcagcggactataaatctacccagtctgccatcgatcagatcactggcaaactaaatcgacttatcgagaaaacaaaccagcagtttgagcttatcgataacgagttcaacgaggtagaaaagcagattggaaacgtcattaactggactcgggattcaatcacagaagtatggagttacaacgctgagcttttagtggccatggaaaatcagcatacgattgatctcgccgactccgagatggataagctgtacgaacgtgtgaagcgccagctcagagagaatgcagaggaggacgggactggctgcttcgagatctttcataaatgtgacgatgactgcatggcaagcattcgaaataacacatacgatcatagtaagtatcgggaggaggctatgcaaaatcggattcaaattgatccggtgaagctgtcgagtggctacaaggatgtgattttatggttttcattcggggcctcctgcttcatcctactggccatagtgatgggcctggtgtttatctgcgtgaaaaatggtaatatgcggtgcaccatctgcatc

SEQ ID NO: 563 - DNA, 1680 bp, Influenza A virus
  misc_feature (1)..(1680): Codon Optimized Sequence Encoding H7 Hemagglutinin
atgaatactcaaattttagttttcgctcttattgccatcattccaactaacgctgataaaatctgcctgggccaccacgccgtcagcaatgggaccaaggtaaacacactcaccgaacgcggcgtggaagtagtgaatgcgaccgaaactgttgagcgcaccaacattccacgaatatgttccaagggtaagaaaaccgtggatctggggcaatgtggccttctggggacgataacaggaccaccccagtgtgaccagtttctggagttttccgcagacctgatcatcgaacgtagggagggaagcgacgtctgttatcccggcaagttcgttaatgaggaggcccttcgacaaatcctgcgcgaaagcggtgggatagacaaagaagccatgggcttcacatacagcgggatcagaaccaacggcgccacaagtgcctgcaggcgatctggctcgtccttctacgcggagatgaagtggctgctgtcaaacaccgacaatgccgcttttccccagatgacaaaaagctacaaaaacacccgaaaaagccctgcattaatagtctggggcatccaccacagcgtgtctaccgccgaacaaacgaagctgtatggttccggaaacaaactagtgacggtgggctcatcaaattatcagcagtccttcgtgccttccccaggggccaggcctcaggtgaatggacaatccgggcgaattgattttcattggctcatgttgaaccccaacgacactgtaacgttttctttcaacggtgcgtttatcgctccagatagggcctccttcctccgaggaaaaagtatgggtatccagagtggcgtgcaggtggatgccaattgcgagggtgactgctaccactctggcggtacaattatctctaatctgcccttccagaacatagacagccgtgcggtcgggaagtgcccccgctacgttaagcaacggtctttattgcttgccactggtatgaagaacgtgccagagataccaaaagggagagggctctttggcgccatcgctggatttatagagaacgggtgggagggcctgattgacgggtggtacggattccgccatcagaacgcccaaggtgaaggcaccgccgccgactacaagagcacccagagcgccattgatcagatcacgggaaaactgaataggctgattgaaaagacaaatcagcagttcgagctgatagacaacgaatttaacgaagtagaaaaacaaatcggcaacgtgatcaactggacaagagactccatcactgaagtgtggagctataatgccgagttactcgtggcaatggagaatcagcatactattgatctggccgattcggaaatggacaagctgtacgaacgcgtcaagcggcaactgcgggagaatgccgaggaggacggtaccggttgtttcgagatttttcataaatgtgatgacgactgcatggcctcaattagaaacaacacatatgatcacagcaagtatcgggaagaagctatgcaaaaccggattcagatcgacccagttaagctgagtagcgggtataaggacgtaatcctctggttttctttcggcgcctcctgttttattttattagcgatcgtgatgggtctggtgtttatctgcgtcaaaaatggtaatatgaggtgtactatatgtatc

SEQ ID NO: 564 - DNA, 1680 bp, Influenza A virus
  misc_feature (1)..(1680): Codon Optimized Sequence Encoding H7 Hemagglutinin
atgaacactcagattctagtatttgcacttattgccatcataccaaccaacgctgacaagatctgtctcggccatcatgcggtcagtaacggtacaaaggtcaatacactgacagaacgtggggtagaggtcgtaaacgcaaccgagaccgtggagagaaccaatattcctcgaatatgttccaaaggcaagaggactgttgatttaggacagtgcgggctgctgggaactataacagggcccccacaatgtgatcaattcctcgagttctcagccgacctcattatcgagagacgcgagggatctgatgtgtgctaccctggcaaattcgtgaacgaggaggccctgcgccagatcttgcgggaaagcggtggaatcgataaggaggccatggggtttacttatagcggcataaggaccaacggcgccacctctgcatgcaggaggagcggcagtagcttctacgcagagatgaaatggctgctgtctaataccgacaatgccgcgttccctcaaatgactaaaagctacaagaatacgcgcaagtctccagccctgatcgtgtggggcatccatcacagtgtctcaactgcagaacagaccaaactttacggttcaggcaacaaactcgtcaccgtcggctcttctaattatcaacagagtttcgtgcctagcccaggcgagcgaccccaggtgaacggtctttccggtcggatcgattttcactggctcatgctcaacccgaacgatactgtgactttcagtttcaacggggccttcattgctccggatcgggcatcatttctgaggggcaagtctatgggcatccagtccggcgtgcaggtggacgctaactgcgaaggtgattgttaccactcgggtggcacaatcatttctaatctacccttccagaacattgactcaagagctgtcgggaagtgtccacgatacgtgaagcagagatccctgctcctcgccacagggatgaagaatgtcccagagattcctaaagggcgcggcctgttcggagctatagcggggttcattgagaatgggtgggaaggcctaattgacggttggtatggttttaggcatcagaatgcccagggcgagggtaccgccgcagattataaaagtactcagtctgccatcgatcaaatcaccgggaagctaaaccggttgatcgaaaaaactaaccagcagtttgagctgattgacaacgaatttaacgaggtggagaaacagatcggcaacgtaattaattggacgcgggatagcatcacagaagtctggagctataatgcagagctcctggtggcgatggagaatcagcacactatcgacttggctgattcggaaatggataagctgtatgagagggtgaaacgtcagctgcgggagaatgccgaagaagatggtaccgggtgtttcgaaatattccataaatgtgacgatgattgtatggccagcatccgaaataacacatatgaccattctaaatacagagaagaggccatgcagaatcgaatacaaatcgaccctgtgaaactgtcctccggatataaagatgttatcctttggtttagcttcggcgcctcttgctttatactgttggcaatcgtgatgggcttggtatttatttgtgtcaagaatggcaatatgcgctgtacgatctgcatt

SEQ ID NO: 565 - DNA, 1680 bp, Influenza A virus
  misc_feature (1)..(1680): Codon Optimized Sequence Encoding H7 Hemagglutinin
atgaacacccagatcttggtgtttgctcttattgcaatcatccctactaacgccgataaaatctgtctgggtcaccatgccgtcagtaatggaaccaaggtaaacacactgacggagaggggcgtggaggtggttaacgcaaccgaaacagttgagcggacgaatatcccccggatatgtagtaagggaaagaaaactgtcgatctgggacagtgcggcctactaggaaccatcactgggcctccccagtgtgaccagttcctggaattttctgccgacctgattatcgaacgccgtgagggatccgacgtgtgctatccaggtaaattcgtgaatgaagaagcacttaggcagatccttcgtgaatctgggggcatcgataaggaagctatggggtttacttattccggtattaggaccaacggggcaacaagcgcctgcagacgaagtggttcgtcattttacgccgagatgaaatggctgttgtccaacactgacaatgctgcttttccccaaatgaccaaaagctataaaaacactcggaaatcacccgccctcatcgtatgggggatccaccattctgtttctactgcagaacagacaaaactgtacgggagcggcaataagctggtgaccgtggggtcctccaattatcaacagtcttttgtcccgtccccaggagcgagaccacaggtcaatggacagtcaggccgaatcgacttccactggcttatgcttaatccaaacgacaccgtcacctttagtttcaatggcgccttcatcgccccagacagagcctcattcctgcgcgggaaatcgatgggcattcagtcgggagtccaagtggacgcaaactgcgaaggtgactgttaccatagtgggggcacaatcatcagtaacctgccctttcagaacatagattcccgcgccgtaggaaagtgtccccggtatgtgaaacagagatcattgttgctggcaacagggatgaaaaatgtacccgaaattcccaaagggcgagggctgtttggagccattgccggttttatcgagaacgggtgggagggcctgatcgatgggtggtacggtttcagacaccagaacgcccagggcgaagggaccgctgcagattacaagtcgacccaatccgcgatagatcagatcactggtaaactcaatcgactcattgaaaagacaaatcaacagttcgagctgattgataacgagttcaacgaagtcgaaaagcagatagggaacgtgatcaattggacacgcgactccatcaccgaagtgtggagttacaatgcagagctgttggtagcgatggagaaccagcatactattgacctggccgattcagaaatggacaagctgtacgagcgcgtcaagcggcaactgcgagagaatgctgaagaggatggaaccggatgcttcgaaatcttccacaagtgcgatgacgactgcatggcctccatcaggaacaatacatacgatcactcaaagtaccgggaggaggccatgcagaaccgtattcagatcgaccccgtaaaactgagctccggctacaaggatgtaatcttgtggttcagcttcggcgcttcatgctttattttactggccatcgtcatgggacttgtctttatctgtgttaagaacgggaatatgcggtgcaccatctgcatc

SEQ ID NO: 566 - DNA, 1680 bp, Influenza A virus
  misc_feature (1)..(1680): Codon Optimized Sequence Encoding H7 Hemagglutinin
atgaatacacagatactggtgtttgccctcattgcaatcattccaaccaatgccgacaagatttgcctgggccatcacgctgtgtccaacggcaccaaggtgaacacccttacagaacgcggggtggaggtggtcaacgcaaccgagaccgtggagagaaccaatattccaaggatctgctcgaagggaaagaagaccgtagatctgggacagtgtgggctgctcggcacaataaccggccccccgcagtgtgatcagttcttggagttcagcgctgatctgattatcgagcggagggagggatccgacgtctgttaccccgggaagttcgtgaatgaagaagctcttagacagatccttcgcgaatctggcggaattgacaaggaagctatgggcttcacttattctggaataagaaccaacggcgcaacctccgcctgtaggcgcagcggatccagcttttatgccgagatgaaatggttgttgtccaatactgacaatgccgctttcccccagatgaccaagtcctacaagaatactcgaaaaagcccagctttgatcgtctggggcatccaccattctgtctccaccgcggagcagaccaagctttatggctctggtaacaagctggtgactgtgggaagcagcaattaccagcaaagtttcgtgcctagtcccggggcccgcccacaggtaaacggccagtcagggagaatagacttccactggctgatgctgaaccctaatgacacggtgacatttagctttaatggtgctttcatcgctcccgatcgcgccagttttctcagagggaagtcgatgggaatccaatccggtgtccaagtggacgccaattgtgagggagactgctatcatagcgggggaacaatcatatctaatcttccatttcagaacattgattctcgagcagttggaaagtgcccccggtacgtgaagcaacgaagcctgctccttgcaaccggcatgaagaatgtgcccgagatcccaaagggacggggcctattcggggccatcgccgggttcatcgagaatggttgggagggactaatcgatggatggtatggctttcggcaccagaacgctcagggcgaaggaaccgcagcagactacaaatcaacacagtccgccatagaccagatcacaggtaaactcaaccgcctgatagagaaaacaaatcagcaatttgaacttatcgacaatgagttcaacgaagtggagaaacaaataggaaacgtaattaactggaccagggactcaatcaccgaagtgtggagctataatgccgagctcctggtggctatggagaatcagcatactatcgacttagctgacagcgagatggacaagctgtatgaacgggtcaaacggcagcttagggagaatgctgaagaggatggcactggctgcttcgagatcttccacaaatgcgatgatgactgtatggcctctattaggaataatacgtacgaccattctaaatacagggaggaggctatgcagaaccggattcagattgatccagttaagctgtctagcggttataaagatgtgattttgtggttctcctttggcgccagctgtttcatcttgctagcaatagttatgggcctagtgtttatctgcgtgaagaacggcaatatgagatgtacaatctgcatc

SEQ ID NO: 567 - DNA, 1680 bp, Influenza A virus
  misc_feature (1)..(1680): Codon Optimized Sequence Encoding H7 Hemagglutinin
atgaacacacagatcctggtatttgctcttatcgctatcatcccgaccaacgccgataagatctgtcttggccaccacgccgtttcgaatggcaccaaggtgaatactcttaccgaacgaggagtggaagttgtgaacgccacggaaacagttgaacgcaccaacatcccgaggatctgttccaaaggcaagaaaacggttgacctgggccagtgtggactgttggggactatcaccgggcccccacagtgtgatcagttcctggagttttctgctgacctgattattgaaagacgggaggggtcagacgtgtgttaccccggcaagttcgtcaatgaggaagctcttcgacagattttaagggaatcgggcggaattgacaaggaagccatggggttcacctactctgggattcgtaccaacggtgctacctccgcttgtcgaaggtctggcagtagcttctacgcggagatgaaatggctcctgtcaaacacagacaatgccgcgttccctcaaatgactaagtcatacaaaaacactcgtaagtccccggctctcatagtgtggggcatccaccatagtgtgagcacagcggagcagaccaaattgtacggaagcggcaacaagcttgtgactgtgggttcctccaactaccaacagagtttcgtgccaagcccgggcgctcgccctcaggtcaacggccagtccggcagaattgacttccactggctcatgctcaacccaaacgacacagttacatttagtttcaatggagcgttcatagcacctgatcgcgcttcttttctgagaggaaaatccatggggattcagagtggtgtgcaagtagatgctaactgcgagggcgactgttaccactctggcggtactatcatctccaacctcccatttcaaaacatagattctcgtgcggtgggcaaatgtccgaggtacgtgaaacagcgatcactcctgctagccaccggaatgaaaaacgtgcccgagatcccgaagggccggggcctgttcggtgccatcgcagggtttatcgaaaacgggtgggaaggcctgatcgatgggtggtatgggtttcggcatcagaacgcacagggagaaggaacagctgctgactacaaaagcacacagtctgccatcgaccaaattacaggtaaactcaataggctcattgagaagaccaatcagcagttcgagctcattgacaatgagtttaacgaggtcgaaaagcaaatcgggaatgtaataaattggacccgcgacagtatcacagaagtctggagttacaacgcagagctgctcgtggctatggagaaccagcacacaattgacttggctgactccgaaatggataagttgtacgaacgagtaaagcgccagctgcgcgagaacgctgaagaggacgggacggggtgtttcgaaattttccacaaatgtgacgatgattgcatggcctctatccgcaacaatacctacgaccacagcaagtaccgcgaggaggccatgcagaaccgcatccaaatcgaccctgtgaagttgtcttccggatacaaggatgtgatcctgtggttctcctttggggccagttgctttatccttctcgcaattgtgatgggactcgtctttatctgcgtgaaaaacggtaacatgcgctgtacaatttgtata

SEQ ID NO: 568 - DNA, 1680 bp, Influenza A virus
  misc_feature (1)..(1680): Codon Optimized Sequence Encoding H7 Hemagglutinin
atgaacacccagatcctagtctttgctctgattgcgatcatccccaccaatgcggataagatctgcctcggacaccacgccgtctctaatggcacgaaagtcaacaccttaacagaaaggggggtggaggtggttaatgccaccgagacagtcgaacgaacgaatattcccagaatttgttctaaaggaaaacgcaccgtggacttagggcagtgcggcctcctcggcactattaccggccctccacagtgtgaccagttcttagagttcagcgccgacctgatcatagagcgaagggaagggtctgacgtgtgctatcctggcaaatttgtgaatgaggaggccttgagacagattcttagggagtcgggcggtatagacaaggaagctatgggctttacatacagtgggatccggacaaatggcgcgacaagcgcatgtaggagaagcggaagcagcttttacgctgagatgaagtggctactctccaataccgataatgccgccttcccacaaatgacaaaatcctataagaacaccaggaagtccccagccctcatcgtctggggaattcaccactccgtctctacagcagaacaaactaaactctacggttccggaaataagctcgttactgtcggcagctccaattaccagcagtcattcgtcccaagtcccggagcaagacctcaggttaatggcctcagcggaagaatcgacttccactggttgatgttaaacccgaacgacacagtgacattctcctttaacggagccttcatcgcaccggatcgggcctcttttttaaggggaaagagcatgggcattcagtccggggtgcaggtcgatgctaactgtgaaggcgattgttatcatagcggaggcaccatcatctcaaatctgccttttcagaacattgactccagagctgtaggaaagtgtcctcgctatgtgaaacaaaggtctcttctgctggcaactggaatgaagaatgtgccagagattcctaagggtcggggactatttggagccatagccggctttatagaaaatggatgggagggcctgatagacggttggtacgggttccgccatcagaatgcccaaggtgagggtacggccgcagactataagtctacacagagcgccattgatcagataaccggaaagctgaaccgtctgatagagaaaaccaaccagcaatttgaacttattgataacgagttcaacgaggttgagaagcagatcggcaatgttattaactggacaagagattcgatcaccgaagtttggtcatacaacgccgaactgctggtagccatggagaaccagcacacaatcgacctcgcagatagtgagatggacaaactgtacgagcgtgtgaagagacagctgagagagaacgcggaggaagacggcactggctgtttcgagattttccataagtgcgatgacgattgcatggcctccattaggaataatacctatgaccattccaaataccgtgaagaagccatgcaaaaccggatccagattgaccccgtcaagctttcgtcagggtataaagatgtgatcctgtggttctctttcggcgccagttgcttcatcctgctcgcaatcgtgatgggactcgtgttcatatgtgtcaaaaacggcaacatgcgctgtacgatctgcata

SEQ ID NO: 569 - DNA, 1680 bp, Influenza A virus
  misc_feature (1)..(1680): Codon Optimized Sequence Encoding H7 Hemagglutinin
atgaacactcagatccttgtctttgccctaatagcaataattccaacaaatgccgataaaatctgtttgggtcatcacgccgtctcaaacggaacaaaggtgaacacactgacagaacggggtgtcgaggtggtcaatgccaccgaaactgtcgaacgcactaatattcccagaatatgctcgaagggtaagaggacggtagacttgggccagtgtggcctgcttggtaccatcactggccctccccagtgtgaccaattcctggagtttagcgcggacctgataattgagagacgtgagggtagcgatgtttgctatcctggaaagttcgtcaatgaagaggccctgaggcagatcctacgagaatccggcgggatcgataaagaagctatgggatttacctactccgggatcaggacaaacggggcaacttcggcatgtcggcggtctggcagctcattttatgctgagatgaaatggttgctctcaaacaccgataacgccgctttcccacaaatcaccaagtcctacaagaacacaaggaagtcccccgctttgattgtctggggcatccaccacagcgtgtcaactgctgagcagaccaagttatacggctcaggcaacaaactcgttaccgtgggatcttcgaattatcaacagagttttgtgccatcccctggtgctaggccgcaagttaatggtcttagtgggcgtatagacttccactggcttatgctgaatccgaacgataccgtcaccttttcattcaacggtgctttcatagcccccgatcgcgcctctttcctcagggggaagtctatgggtattcagtcaggtgtgcaggtggatgcgaattgtgagggagattgttaccactccgggggcaccataataagcaatcttccctttcaaaatatcgactctcgggcggtcggaaaatgtccgcgctatgtgaagcagcggagtctcctgctggcaacagggatgaaaaatgtgcccgagattcctaaaggaagaggtttgtttggtgcgatcgctggttttatcgagaatgggtgggagggcttaatcgacggttggtatgggtttagacaccagaacgcccagggagagggtaccgcagccgactataagagtacacagagcgcaatcgaccagatcacaggcaaactcaaccgcctaattgagaaaactaaccagcaattcgagttaatcgacaatgagttcaacgaggtagaaaagcaaataggcaacgtcattaattggacccgggacagtataacagaggtctggagctataatgccgagctgttggtggccatggaaaaccagcacacgatcgacctggcagacagcgaaatggacaagctgtacgagagagttaagcgccagttgcgcgagaacgccgaggaagatggcaccgggtgcttcgaaatctttcacaagtgcgatgacgactgcatggcttctattcgaaataatacttatgatcatagcaagtatagagaagaagccatgcagaataggatccagatcgacccagtaaagttgtcttctggctacaaggatgtgatactgtggttctcctttggggctagttgctttattttgctggctattgttatgggtctggtgttcatttgtgtgaagaatgggaacatgcgctgcacgatatgtatc

SEQ ID NO: 570 - DNA, 1680 bp, Influenza A virus
  misc_feature (1)..(1680): Codon Optimized Sequence Encoding H7 Hemagglutinin
atgaatacccagatcctggtgttcgcactgatcgccattatacccaccaacgccgacaagatctgccttggccaccacgctgtttctaatggaacgaaggtcaatactctgaccgagaggggggtggaagtcgtgaacgctacagagactgttgaaaggacaaatattccgcgcatttgcagcaaagggaagcgaaccgtggatttgggccaatgtggcctccttggcactattacaggcccacctcagtgtgatcagtttctggaattctccgctgacctcattatagaacggagagaaggatcagacgtttgttaccctggcaaattcgtgaatgaggaggccttgagacagatactcagggagtccggcggcatcgacaaggaagcaatgggtttcacctacagcggcattcgcaccaacggcgccacctccgcctgccgccgcagcgggtctagcttttatgccgaaatgaaatggctcttaagtaatacagacaacgctgcctttccccagatgacaaaatcatacaagaacacaagaaaatcacccgcacttatagtttgggggatccatcactccgtgtccaccgctgagcagactaagttgtacgggagtggaaacaaactggttacggtgggtagttctaactatcagcagtcctttgtgccttcgcccggagctcgcccacaggttaacggtctgagcggtcgcatcgacttccactggctaatgctgaaccctaacgataccgtgacattctcttttaatggagctttcatcgcccccgaccgcgcttcctttttgagggggaagtccatgggtatccagagcggagtgcaggtggacgccaattgcgagggagattgttatcattctggcggcaccattatctctaatttaccgtttcagaatatcgactcaagagcagtgggcaagtgccctcgatacgtgaagcagcgcagcctgcttcttgctacaggaatgaaaaacgtcccggagattcccaaggggcggggcctgttcggcgccatcgcaggcttcatagagaacggttgggagggactgattgatggatggtacgggttccgccatcagaacgcccagggcgaaggaaccgctgcggactacaagtccacccagtccgcaatcgaccagataacgggcaagttgaataggctcatcgaaaaaacgaaccaacaattcgagcttattgataacgagtttaacgaagtagaaaagcagattgggaatgtgataaactggaccagagatagcatcaccgaggtgtggagctataatgcagaactgctagtagctatggaaaatcagcacacaatcgacttagccgatagtgagatggacaaattgtatgagcgagtaaaaagacaattaagagaaaacgcagaggaggatggcaccggttgtttcgaaatctttcacaaatgtgatgacgactgtatggcctcaattcggaacaacacctacgaccacagcaaatacagagaagaggccatgcagaatcgcatacagatagatccagtcaaactgtcatctgggtacaaggacgttatattatggttctctttcggggcaagctgcttcatccttctggctatcgtgatgggcttggtcttcatctgcgtcaagaatggaaacatgcgctgcaccatctgcatc

SEQ ID NO: 571 - DNA, 1680 bp, Influenza A virus
  misc_feature (1)..(1680): Codon Optimized Sequence Encoding H7 Hemagglutinin
atgaatacccagatcctggttttcgccctgatcgctatcattcctactaacgcagataagatctgcctggggcaccatgcagtcagcaacgggaccaaggtgaacacactgactgagcgtggagtcgaggtcgtcaatgcgactgagacagtagagcggacgaacatacccagaatctgcagcaaagggaaacggacggtagacctcggccagtgcggtctcctgggtaccatcacaggtccaccccaatgcgatcagtttctggagttctccgccgacctcatcatcgaacggcgcgaggggtccgatgtctgctaccctggtaaattcgtcaatgaagaggctctccgtcagattcttcgggaatcaggggggattgacaaggaagctatgggatttacatactccggtatacgaaccaacggagctaccagtgcttgccgacggtcagggtcatcattctacgccgagatgaaatggcttctctcgaacactgataatgctgcgtttccacaaattaccaaaagctacaaaaacacccggaagtcccctgcactgatcgtgtggggaattcaccacagcgtctctacggctgaacagaccaaactgtacggatcaggcaacaagttggtgactgtcgggtcatccaattatcagcagagtttcgttcccagccctggcgcaagacctcaggtgaacggcttgtccgggaggattgattttcactggctcatgctgaatcctaatgacactgttaccttttcttttaatggggcttttattgcaccggaccgagcaagttttctacgcggaaagtccatggggatacagagtggggtgcaggtggatgctaattgcgagggcgattgttatcacagcggcggcaccataatatcaaacctgcccttccagaacatcgactccagggccgtgggcaagtgtccaagatacgtcaaacaaagatctctgctgctggccactgggatgaaaaacgtcccagaaatcccaaaagggagggggctcttcggagccatagccgggtttatcgaaaatggatgggaaggtctgatagacgggtggtacggtttcagacatcagaacgcacagggcgagggaacagccgccgactacaagagcacccagagtgcaatcgatcagatcactggtaagcttaataggctgatcgaaaagactaatcaacaatttgagctgatagacaatgaattcaacgaagttgaaaagcagataggtaatgtaatcaattggacccgagattcaataactgaagtctggagctacaatgccgaactgttggtggctatggagaaccaacatacgattgacctggccgactccgagatggacaagctgtatgagcgggtaaagagacagctgagggagaatgccgaggaagatggcaccggatgtttcgagatttttcacaagtgtgatgacgactgcatggcgtctatccggaataacacctacgaccactcaaaatatcgggaagaagcgatgcagaatcgaattcagatcgacccagtcaaactgtcgagtggctataaagatgtgatactgtggtttagcttcggggcatcttgtttcattctgctggctattgtgatgggcctcgtgttcatttgcgttaagaatgggaatatgcgatgcaccatttgtatc

SEQ ID NO: 572 - DNA, 1680 bp, Influenza A virus
  misc_feature (1)..(1680): Codon Optimized Sequence Encoding H7 Hemagglutinin
atgaatactcaaatacttgtctttgcactaatcgctatcatacccactaatgccgataaaatctgcttaggacaccatgctgtgtccaacggaactaaagtgaacactctgacggagcgaggcgtcgaagttgtcaacgcaaccgagactgtggagcgcacgaatatcccccgaatctgctcgaaaggaaagaagactgttgaccttggtcaatgcggattactgggaaccatcacaggacccccccaatgcgaccagtttctggaatttagtgctgatcttataatcgagcgccgggaaggtagcgacgtttgttatccgggaaagtttgtaaacgaggaggctctgagacagatcctgcgcgagtcaggggggatcgacaaggaggccatgggctttacctactctggaatcagaacaaatggcgctacttccgcttgtcggcgctctggaagcagcttctatgctgaaatgaaatggctgctgtccaacaccgacaatgcagcctttcctcagatgactaaatcttacaaaaatacccggaaatccccagctctgatagtgtggggtatccatcactcagtcagtactgctgaacaaaccaagttatatggctccggcaataagctagtaaccgtgggaagctccaactaccaacagtctttcgtgccctcacccggcgcaagaccccaggtgaacggccagtcaggtcgcattgatttccactggttgatgcttaacccaaatgacaccgttaccttttccttcaatggcgcctttatagcgcccgacagagcttcattccttagaggcaagtctatgggtatccaatccggagtccaggtagacgcaaactgtgagggagactgctatcattccggtggaaccatcatatcgaatttgcctttccagaacatcgatagccgggcggtcggcaagtgccctagatacgttaaacaaaggagcctgctcttagcaacaggtatgaagaacgtcccagagattccaaagggccgaggactgttcggtgcaatagctggctttatcgagaatgggtgggaggggctcatcgatggttggtatgggttcagacaccagaatgcccagggcgaaggaaccgctgctgactacaaaagcacacagagcgctatagatcagataacaggcaagcttaaccggctgatcgagaaaacgaatcagcagttcgaactcattgataatgagttcaacgaagtggagaagcagattggtaatgtcatcaactggactagagatagtataacagaagtgtggtcttataacgccgaactcctggtcgcaatggaaaatcaacataccattgacctggctgattcggagatggacaaactttatgagcgggtgaagaggcagctccgagagaatgcagaagaggacggcacagggtgctttgagatcttccataagtgcgacgatgattgcatggcttccatcaggaataatacttatgaccactccaagtaccgggaggaagccatgcaaaatcggatccaaatagatccagtgaagctttcgtcaggatataaggacgtgatcttgtggtttagcttcggggcctcttgtttcatcctcctggcgattgtcatgggacttgtattcatttgtgtgaagaacggaaacatgcgctgcaccatttgcata

SEQ ID NO: 573 - DNA, 1680 bp, Influenza A virus
  misc_feature (1)..(1680): Codon Optimized Sequence Encoding H7 Hemagglutinin
atgaacacacagatccttgtgttcgcccttatcgcaataattcccacaaacgccgacaaaatatgcctgggtcaccacgccgtaagcaatggcaccaaagttaacaccctcaccgagcgtggggtggaggtggtgaacgccaccgagaccgttgaaaggacaaacattccacgaatttgtagtaagggcaaacggactgtagatctgggtcagtgtgggctgctgggcactatcaccggcccaccacagtgcgaccaattcctagaattctcagctgatttaatcatcgaaaggcgcgaggggtctgacgtctgttacccgggaaaatttgtgaacgaagaggccctgcgacagattctgcgtgagtccgggggaatcgacaaagaggcgatgggatttacctattcaggcatacggaccaatggagctacttctgcatgccggaggagcggctcgtctttctacgctgaaatgaagtggttgctgagtaataccgacaacgcagccttcccccagatgacaaagagctacaagaacacacgcaagtcacccgcactcatagtctgggggattcatcactcagtcagtaccgcggagcagaccaagctctacggtagcggcaacaagctggtcacagttggttctagtaattaccagcagtcctttgttccctcccccggcgcccgtccccaagtcaacgggctctcgggcagaatcgacttccactggctcatgttgaaccccaacgatactgtgacattctcttttaatggtgcttttatcgcgccggacagggcctctttcttacgcggcaagagcatgggtatacagtctggagtccaggttgatgctaattgcgaaggcgactgttatcattcaggaggcaccatcatatcaaacctgcccttccaaaatatagatagtcgggctgtgggtaaatgccctaggtacgtcaagcagagaagtcttctgctcgccactggcatgaaaaacgtaccagagattcctaaaggaagaggcctatttggagcaattgccggctttatcgagaatgggtgggaaggccttataaacgggtggtatggcttcaggcaccagaacgcccagggggagggtaccgccgccgattacaagagcactcagagtgccatagaccagattactggaaaattaaatagactgattgagaaaacaaaccagcagtttgaactgattgacaatgaattcaatgaggtggagaagcagattgggaacgtgatcaattggacccgggactctattactgaggtatggagctataacgctgagcttttggtggccatggagaaccaacatacgattgatctggcagatagcgaaatggataagctttatgagcgtgttaagaggcagctccgcgaaaatgccgaagaggatggtacgggatgcttcgagattttccataaatgcgacgacgattgcatggctagcattaggaacaacacctatgaccacagtaaatatagagaggaggccatgcaaaatcgcattcagatagaccctgtcaagttgagctcggggtataaggacgtcatactttggtttagttttggggcgagctgttttattttgctggccatagttatgggtctggtctttatttgtgtaaagaacgggaatatgcgttgcaccatttgcata

SEQ ID NO: 574 - DNA, 1680 bp, Influenza A virus
  misc_feature (1)..(1680): Codon Optimized Sequence Encoding H7 Hemagglutinin
atgaacacccaaatattagtgttcgccctcatagcaatcattcccacaaatgctgataagatttgccttggtcatcatgctgtgagtaacgggaccaaggtgaacactcttacggagcgcggggttgaagttgttaacgctaccgagaccgttgaaagaaccaacatcccacgaatctgcagcaaggggaagcggaccgtggacttgggacagtgtgggttgttggggactatcaccgggccccctcagtgcgaccagttcctcgaattcagcgccgatctgatcatagagcgacgggaggggagtgacgtttgctaccccggtaaattcgtgaaggaagaagccctgagacagattctacgggagtctggcggcatagataaagaggctatgggtttcacatatagcggcatccgcacaaacggagccacttctgcctgcaggagatctggctcctctttttacgctgaaatgaaatggttactgtccaacaccgacaatgccgcctttccccaaatgaccaagtcatacaagaatacccggaaatccccagctttgatcgtttggggtatccatcactcagtttctaccgcggagcagactaaactctatggctctggaaataagctggtgacagtgggctcttccaattatcagcagtcgtttgttccgtcccctggcgctagaccacaggtgaacggcctgtccgggcgaatcgatttccactggctgatgctgaacccgaacgacaccgtcacatttagcttcaatggagccttcattgctcccgatcgagcttctttcctgcggggcaaatcaatgggcatacaatcgggtgtgcaggtggacgccaattgtgagggagactgttaccattcaggcggcaccattattagcaatctaccattccagaatatagactcccgggctgttggcaagtgcccccggtatgttaaacagcggtccctgctcctggctaccggtatgaagaatgttccggaaatcccgaaggggcgcggactcttcggcgctatcgcgggttttatcgagaacgggtgggagggccttatcgatgggtggtacggcttccggcaccagaatgcccagggagaaggcaccgccgccgactataagtcaacacagtccgcaattgaccaaatcaccggtaagctgaatcgcttaattgagaaaaccaaccaacaattcgaactgattgataacgaattcaacgaggtcgaaaagcagatcgggaatgtgatcaactggacccgcgatagcattaccgaggtctggtcttacaacgcagaacttctcgttgcgatggagaatcaacacactattgatctggctgactccgagatggacaagctgtacgagcgcgtgaagcgccagctgcgggaaaatgcagaagaggatggcactggctgcttcgagatcttccacaagtgcgatgatgattgcatggcatcgatcaggaacaatacatacgaccactcgaagtacagagaggaggctatgcagaaccgaatacagatagatccagttaaactatcatccgggtacaaggacgttatcctgtggttctcatttggagcatcctgcttcattcttctcgcaatcgtcatgggactggttttcatctgtgtgaagaacggcaacatgcggtgcaccatctgcatc

SEQ ID NO: 575 - DNA, 1680 bp, Influenza A virus
  misc_feature (1)..(1680): Codon Optimized Sequence Encoding H7 Hemagglutinin
atgaatacccagatattagtatttgcccttatagccatcatccctactaacgcggacaaaatctgcctgggacaccatgccgtttctaacggtacaaaagtcaacaccttaacggaacggggggtggaagtggttaatgctacagagaccgttgaacgcaccaacatcccccgcatttgctccaaagggaagaaaactgtggacctaggtcagtgtggcctgttgggtactatcaccggcccacctcaatgcgaccagtttctggagttcagcgccgatctgatcatcgaaagaagagagggtagcgacgtttgttatcctggaaagtttgttaatgaagaggctctgagacagattttgcgagaatccgggggaatcgacaaggaagccatgggctttacatactctggtattaggaccaacggtgccacttctgcctgcagacggagcggtagttctttttacgccgaaatgaaatggctattgtctaatacggataacgctgcatttcctcagatgacgaaatcatacaaaaatacaaggaaaagccccgctctgattgtgtggggtatccaccactccgtatccacagcagaacaaacaaagctgtatggatctggtaacaagctcgtgacggtgggctctagcaactatcagcagagttttgtgccatcacctggcgcaagaccccaggtcaacggccagtccggccgaatcgacttccactggcttatgctaaaccccaacgacacggtgactttcagttttaacggcgcctttatcgctcctgatcgcgcttctttccttaggggtaaatctatggggatacaatcaggagtgcaggtagacgctaactgcgaaggagactgctatcactctggaggaacgataatctccaatttacccttccagaacatagacagtcgggccgtcgggaaatgccccaggtacgtgaagcagcggtctcttctgctcgcgactggcatgaaaaacgttcccgagatacccaagggaaggggcctgttcggcgcaattgctgggttcattgaaaacggctgggagggccttattgatggttggtacggattcagacaccagaatgcacagggcgagggcacagccgccgattataagtcaacgcagtcagcgatagaccagataaccgggaaattgaaccgtctgattgagaaaacaaaccagcaattcgaattgattgataacgagtttaatgaggtggaaaagcagattggaaacgtcattaactggacacgagattcaattacagaggtgtggagctataacgcggagttgctggtcgctatggaaaaccaacatactatagatcttgccgattccgagatggacaaactctatgagagagtcaaacgacaattaagggaaaacgccgaggaagatggcaccggatgcttcgaaatcttccataagtgcgatgacgactgtatggcatctattcgcaacaacacgtacgatcactcgaaatatcgggaagaggccatgcagaataggatccagattgaccctgtcaaattgagcagcggctacaaggatgttattctgtggttcagtttcggcgcctcctgtttcatcttactcgctattgtcatgggcttagtgttcatctgtgtcaagaatggcaatatgcggtgcactatatgcatt

SEQ ID NO: 576 - DNA, 1680 bp, Influenza A virus
  misc_feature (1)..(1680): Codon Optimized Sequence Encoding H7 Hemagglutinin
atgaacactcagattctggtgttcgccctaattgccattattcccaccaatgccgacaaaatttgcctgggccatcatgccgtctcgaacggtaccaaagtcaataccctgacagagcgcggcgtggaggtggtgaatgcaactgagaccgtcgagaggactaatatccccagaatttgctcaaagggaaagaaaacagtggatctgggtcagtgcggtctcttagggactatcactggtcctcctcagtgcgaccagtttctggaatttagtgctgatctgattatcgagcggcgcgaagggtccgacgtttgctaccccggaaagtttgttaacgaggaagccttgcggcaaatcctgcggaagtccggcggcatcgacaaggaggccatgggctttacatactctggcatccgcaccaacggagctaccagcacctgtaggaggtctggtagttcattctatgctgagatgaagtggctgctcagtaataccgacaatgctgcttttcctcagatgacaaaatcatacaagaacacgagaaaaagcccagctattattgtatgggggattcatcattctgtcagtaccgctgagcagactaagctttacggtagcggaaataagcttgtcacagtggggtccagcaattaccagcagtcgtttgttccctccccaggagcacgcccccaagtcaacggtctatcggggaggatcgacttccattggctgatgctcaatcctaacgacaccgtgacattctctttcaatggcgcctttatcgcaccggaccgtgcctgttttttacgcggtaagtcaatggggatacaatctggagtccaggtggacgccgactgtgaaggggactgctatcattcgggtggtactattatcagcaatctgcccttccaaaacatagactcaagagctgttggaaagtgcccgagatacgtgaagcaaaggtcactcttgcttgcaaccgggatgaagaacgtgcctgagatcccgaagggccgagggctgtttggtgctatagctggcttcatcgagaatggatgggagggtttaattgacggctggtatggatttcggcaccagaatgcacagggagaagggaccgccgccgattacaaaagtacgcagagtgctatcgatcagattaccggtaaattgaataggctgattgaaaaaactaaccagcagttcgagctgattgataacgagttcaacgaggtcgagagacagattgggaacgtcattaattggacgagagactcaatcacggaggtctggagctacaatgctgagctgttagtagcaatggaaaatcagcacactattgacctcgccgactccgagatggacaaactgtacgaacgggtgaagcggcaacttcgcgaaaacgctgaggaagacggcacgggatgtttcgaaatcttccataaatgcgacgatgactgcatggcctctatccgtaataacacatatgaccatagtaagtatagggaggaagccatgcagaatcgaatccagatcgaccccgtgaagctgagctccggctacaaagacgtcatcctctggtttagctttggggcgtcttgtttcattctcctcgcgatcgtgatgggtcttgtcttcatttgcgtgaaaaacgggaatatgaggtgtaccatttgtatc

SEQ ID NO: 577 - DNA, 1680 bp, Influenza A virus
  misc_feature (1)..(1680): Codon Optimized Sequence Encoding H7 Hemagglutinin
atgaatacccaaatacttgtgtttgccttgattgccataattcctaccaatgccgacaaaatctgcctgggccatcatgccgttagtaatgggactaaggtgaacaccctgacagaacgtggcgtggaggtggtcaacgcaacagaaaccgtcgagaggaccaacattcctcggatatgttcgaagggaaagaagacggtggacctggggcaatgcgggctgctcggcaccattacgggtccacctcagtgtgatcagtttctcgagttttctgcagacctcatcattgaacgtagagagggctcagacgtgtgttacccaggcaaatttgttaacgaggaagccctgcgccagatcctgcgagaatctggcggcattgacaaagaggctatgggattcacgtactctggtatccgtaccaacggcgccacgtccgcctgtagaaggtcaggctcatctttttacgccgagatgaaatggctcctgtctaatacggacaatgccgcatttcctcagatgaccaaaagttacaaaaacacccggaagagtccagctctgattgtgtggggcatccatcacagcgtgtcaactgcggaacagaccaagctgtatgggtccggcaataaactggtgactgtgggttccagcaattaccagcaatcctttgtgcccagccctggcgctagaccgcaagtgaacgggcagagcgggaggattgacttccactggctgatgctcaatcccaacgataccgtaaccttttcatttaacggcgctttcatcgcccccgatagagctagtttcctacggggaaaaagcatgggtattcaaagtggtgtgcaggtagacgcaaattgtgaaggcgactgttaccattcgggtgggaccattatctccaacctgcccttccagaacattgattcacgcgccgtgggaaagtgccctaggtatgttaaacagagaagcctgctgttggccacagggatgaagaatgtgccagagattccaaagggacggggactctttggtgcgatcgcaggcttcatcgagaacggttgggaagggctgatagatggatggtacggtttccgtcaccagaacgcccaaggagaggggacagccgcggactacaaatcaacgcagtctgccattgaccaaatcactggcaaactgaaccggcttatcgagaaaaccaaccagcagtttgaactgatagataatgaattcaacgaggttgagaagcaaattgggaacgtcataaattggactagagactctatcacagaggtgtggtcatataatgcagagctgttggtggcaatggaaaaccagcacactatcgacctagcagattctgagatggacaagctatatgaacgcgttaagcggcagctgcgggaaaacgcagaagaagacggtacaggttgtttcgagatatttcacaaatgcgacgatgattgtatggcatcgatcagaaataatacgtatgaccactccaaataccgagaagaggctatgcagaaccgaatccagattgatcctgtaaagctcagttctggctacaaggacgtcattctctggtttagctttggagcctcctgtttcattcttttggccatcgttatgggcctcgtgtttatttgcgtgaaaaatggtaatatgcggtgtaccatatgtatc

SEQ ID NO: 578 - DNA, 1680 bp, Influenza A virus
  misc_feature (1)..(1680): Codon Optimized Sequence Encoding H7 Hemagglutinin
atgaatacccaaattctggtttttgcgctgatcgcgatcataccgaccaacgcggataaaatttgtctcgggcatcacgccgtgagcaatgggaccaaggtaaacacactgacggagcggggggtggaggtggtgaacgccacagagacggtcgagcggacaaatattcctcggatatgctccaagggcaagaagactgttgatttaggccagtgcggcctcctcggcaccatcaccggaccgccccagtgcgaccagttcctggagttttccgctgacctgatcatcgaaaggagagagggaagcgatgtgtgttaccctggaaagtttgttaatgaggaggccctaagacagattctgcgggaatccggcggcatcgagaaggaggccatgggatttacttacagcgggattagagcgaacggagctacatctgcctgtcgcaggagtggatcttccttctacgctgagatgaaatggctgctctcgaatacggacaacgccgcgtttcctcaaatgactaaatcttacaaaaacactcggaagtcccccgcgctcattgtgtggggaatccaccacagtgtgagtacagccgagcagactaaactgtatggcagtgggaataagctggtcacagttgggtcctccaactaccagcagagcttcgttcccagtccgggcgcacgcccgcaggttaatggccttagcggtagaatcgatttccactggctgatgctgaatcctaacgatactgtgactttcagcttcaatggcgcttttattgcacccgacagagcttcttttctgcgtggcaaatccatgggcattcagtccggcgtgcaggtggacgccaactgcgaaggcgattgttaccactctgggggcaccatcatctccaacctcccttttcaaaacatagacagtcgcgctgtgggaaaatgtccaaggtacgttaaacaacggtctctgctactggctaccggcatgaagaatgtgcccgaaatccccaagggacggggcttatttggcgcgattgccggatttattgaaaatggctgggagggcctcattgacggatggtacggttttcgacaccagaacgctcagggtgaagggaccgctgcagactacaaatccacgcagtccgctatcgatcagattacaggaaagctgaacagactaatcgagaagactaatcagcagttcgagctaatcgataatgagttcaacgaggtcgaaaagcagattgggaacgtcatcaactggactcgcgatagcatcacggaggtatggtcttataatgcagagttgctggtggccatggaaaatcagcatacaatcgacttggctgactctgagatggataaattgtatgagagggtaaaaaggcagttgagagagaacgcggaggaagatggcactggttgcttcgagatctttcacaagtgtgacgacgattgcatggccagtattagaaataatacatatgaccacagcaagtacagggaggaggccatgcagaatcgtatccaaatcgatcccgtgaaattgtcaagcggatataaagacgttatactatggttctcctttggggctagttgtttcattctcctggcgatcgtcatgggcctggttttcatctgcgttaagaatgggaatatgagatgtactatctgcatc

SEQ ID NO: 579 - DNA, 1680 bp, Influenza A virus
  misc_feature (1)..(1680): Codon Optimized Sequence Encoding H7 Hemagglutinin
atgaatacccagattctggtgttcgctctcattgcaataatcccgactaacgctgataaaatctgtcttggccaccacgctgtgagtaatggaacgaaagtcaatacgctcactgagcggggagtcgaagttgttaacgctaccgagaccgtggagcggacaaacataccgcggatttgctcaaagggcaaaaagacagtggatctgggtcagtgcggccttctcggcacaatcaccgggcccccacagtgtgaccaatttctcgagttttcagctgatttgataattgagcgccgggagggcagtgatgtatgctatccagggaagttcgtgaatgaagaggccctccgccaaattctccgggaatctggcgggattgacaaggaagccatggggttcacttactctggaattcggactaatggtgctaccagtgcttgccgtagaagtggtagcagtttctatgccgaaatgaaatggttgttaagcaataccgataacgcagcatttccccagatgacaaagtcgtacaaaaacaccaggaaaagtcctgctctgatcgtgtggggtatccatcactctgtgagtacagcagaacagactaaactgtatggatcaggcaataagttggtgacagtaggctcttcgaattaccaacagtcatttgtccccagcccgggagcccggccacaggtcaacggccaaagcggacgcatcgatttccactggcttatgctgaatcctaatgacaccgtcacattttccttcaatggggcctttattgccccagatcgtgcatcctttctgagagggaaatccatgggtatacagagcggggtgcaggtggacgcaaactgtgagggagattgttaccattctggcggtacgatcatcagcaacttgccattccagaatatagactcccgggcagtcggtaagtgtccccggtacgtcaaacaaagaagcttgctgctggccaccgggatgaaaaatgttcccgagatccccaaggggcgtggcctctttggcgcaatcgcagggtttatcgagaatgggtgggaagggctgatcgacggctggtatggattcaggcaccaaaacgcacagggagaagggacagccgccgactacaaaagcacacagagtgcgatcgatcaaatcacaggtaaattgaaccgactgattgagaagacaaaccaacagtttgagctcatagataatgagttcaacgaggtggagaagcagataggaaatgtgatcaactggacaagggattccatcactgaagtctggtcctataatgccgagctgttggttgccatggaaaaccagcataccattgacctcgccgattccgaaatggataagctgtacgaaagggtgaagcggcagttgcgggagaacgcagaagaagatggaacaggatgctttgagatatttcacaaatgcgatgatgattgcatggcctcgatacgcaacaatacctatgaccatagcaagtaccgagaggaggcgatgcaaaacaggatccagattgacccagtgaagctcagcagtgggtacaaggatgtcattttgtggtttagctttggagcctcatgcttcatactcctcgccatcgtcatggggttggtatttatctgcgtcaagaacggcaatatgaggtgtactatctgcatc

SEQ ID NO: 580 - DNA, 1680 bp, Influenza A virus
  misc_feature (1)..(1680): Codon Optimized Sequence Encoding H7 Hemagglutinin
atgaatactcagattctggtgtttgcgcttatcgctattatacccactaatgccgacaaaatctgtctgggccatcacgccgttagcaacggcaccaaagtgaacacactcacagaacgtggtgtggaagtcgtcaatgccaccgagacagttgagcgcaccaatattcctagaatctgttccaaaggcaaaaaaactgtcgatctaggccaatgcggactgctcggaactattactggaccaccgcagtgcgatcagttcctcgagttcagcgcagacctgatcatagagaggagagaaggtagcgacgtttgttaccctggaaaatttgtcaacgaggaggcgcttcgacagattctcagagagagtggaggtatagataaggaggccatgggtttcacgtattcaggtatcagaacgaatggggcaaccagtgcctgtcgccggtcaggcagcagcttctatgcagagatgaagtggctcctgtcaaacacagacaatgctgcattcccacagatgaccaagagctacaagaacacgcgaaagtcacctgcattaatagtctggggtatccaccactctgtctccactgccgaacagaccaaactttacggatctggaaataagctggtcactgtggggtcttctaattatcagcagagttttgtaccctcgcccggggcccggccccaggtaaacggacagtccggacggattgactttcactggctcatgcttaacccaaacgacacagtgaccttcagttttaacggcgctttcatcgctcccgacagggcctcattcctgaggggaaagtcgatgggaatccagagcggggttcaggttgatgcaaattgcgaaggggattgttaccattccggcggaaccattatctccaacctgccatttcagaatatagatagccgcgccgtgggaaagtgccctaggtacgtcaaacagcggtctctgctcctggctacaggcatgaaaaatgttccggaaatcccaaaggggcggggactcttcggagccatcgcaggcttcatcgaaaacggctgggaggggttaatcgatggatggtatggcttccgccatcagaacgcacagggggagggcaccgcggccgattataagagtacccagagcgcaatagatcagataactggtaagttgaatcggttaattgaaaaaactaaccagcagttcgaactaatcgataatgagttcaatgaagtcgagaaacagataggcaacgttatcaattggaccagggacagcataacagaagtgtggtcctataacgccgaactcctcgttgccatggagaaccagcataccattgacctggctgattcagagatggataaactatacgaacgggtcaagcgtcaattgagagagaatgcggaagaggacgggactgggtgcttcgaaatcttccataagtgtgatgacgattgtatggcgtccattcgcaataacacctacgatcattcaaaataccgtgaagaggcgatgcagaataggattcagatcgacccagtgaagctcagtagtggatataaagacgtaattctctggttctctttcggagctagctgcttcattcttctggccatcgtgatgggactcgttttcatatgtgttaaaaatggcaacatgcgttgcacaatctgtatc

SEQ ID NO: 581 - DNA, 1680 bp, Influenza A virus
  misc_feature (1)..(1680): Codon Optimized Sequence Encoding H7 Hemagglutinin
atgaacactcagattttagttttcgctctaattgccattattcctacaaatgctgataaaatatgcctgggacaccatgctgtctccaacggtaccaaagtcaatactcttacggagaggggggtggaggtagtgaacgccaccgagacagtcgaacgtacaaatatacctcggatttgctccaagggaaagaagacagtggatctggggcaatgtggtctgctgggaactatcacaggcccaccgcagtgcgaccagtttcttgagttttcagccgacctgatcatcgagcgacgcgagggcagcgacgtgtgttaccccgggaagttcgtaaacgaggaagctctccgccagatcctgcgcgagagtggaggtattgataaggaggccatgggctttacatattctggcatccggaccaatggggccacaagcgcctgtaggagatctggatccagtttttacgccgaaatgaaatggctgctgagcaacacagacaatgccgcctttcctcagatgacaaagagctacaaaaacacaaggaagtcacccgcccttattgtctggggtatccatcactctgtcagtacagctgagcagaccaagctgtatggttctggcaataaattggttaccgtcgggagcagtaactatcaacaatcatttgttccaagtccaggagcccggccccaggtcaatggtcaaagtggaaggattgactttcactggttaatgcttaatcccaacgataccgtgaccttctcatttaatggggcctttattgctccggaccgtgccagctttctccgcggtaagtccatgggcatccagtccggcgtacaagtggatgccaattgcgaaggcgactgttaccactctggcggcaccatcatctcaaaccttccgttccagaacatagatagtcgggccgtgggcaagtgccctaggtatgtgaagcagcgctcattactgttggctactggcatgaaaaatgtgccagagatccctaaaggtcgtggtctttttggagctatcgctgggttcattgaaaatggatgggaggggctgatcgacggttggtacggattccggcatcagaatgcacagggcgaaggcacagccgctgattacaagagcacccagtcagctattgaccagatcacagggaagctgaaccggctaatcgagaaaacaaaccaacaatttgaacttatcgataacgaatttaatgaggtggagaaacagataggcaacgtgatcaactggacacgggatagtatcactgaggtgtggagttacaatgccgaactcttggtggctatggagaatcagcatactatcgatctagcggactctgagatggacaaactctatgaacgagtgaagaggcagcttcgcgagaacgctgaggaagatgggacagggtgttttgaaatttttcataagtgtgatgatgattgcatggcatctatccggaataacacatacgaccattccaagtaccgtgaagaggctatgcaaaaccgaattcagatagacccagtgaagctctcttccggatacaaggatgtaattctgtggttttcattcggtgcatcctgcttcatcctgcttgcaatcgtgatgggtttagtgttcatctgtgtgaagaatgggaatatgaggtgtacaatttgcatc

SEQ ID NO: 582 - DNA, 1680 bp, Influenza A virus
  misc_feature (1)..(1680): Codon Optimized Sequence Encoding H7 Hemagglutinin
atgaacacgcagatcctggtgttcgcactgattgcaattattcccaccaatgccgataagatctgtttaggacatcacgccgtgtccaacggtacgaaggtgaacacattgaccgagcggggagtcgaagtggtaaatgcaaccgagactgttgaacgcacaaatatcccaagaatttgttcaaagggtaaaaaaaccgtggacctcggacagtgcgggctgcttggaacgattacaggacctccacaatgcgaccagttcctggaattttccgctgacctcatcatagaacgacgggaagggtccgacgtgtgttatccgggaaagttcgttaacgaggaggctctgaggcagatcttgagggagagtggtggcatcgacaaggaggcgatgggcttcacatacagtggcatcagaactaacggagccaccagcgcatgtcgacggtctggtagcagtttttatgcagagatgaagtggttgctgagcaatacagataatgccgcattcccccaaatgacaaagtcctataagaacacgcggaaaagtcctgccctaattgtgtggggaatccaccactctgttagtaccgctgagcagaccaagttatacggcagcgggaacaagttggtgacagttggatctagtaactaccagcaaagcttcgttcctagcccgggggcacgtccccaggtgaacgggcagagtggccggatcgattttcattggctgatgctcaatccaaacgacactgtcacattcagttttaacggagcctttatcgcccctgatagagcctcattccttaggggaaaaagtatgggaatccagtctggtgtacaggtggatgccaactgtgaaggtgactgttatcattcaggtggaaccatcatatcaaacctgcccttccaaaatattgactcaagagcagtgggcaagtgcccccgatatgtgaagcagcgatccctgctgctcgcaactggcatgaagaatgtcccggaaatccctaaggggcggggccttttcggggcaatcgcaggcttcatcgaaaatggatgggagggcctgatcgacggatggtacggtttccggcatcagaatgctcagggggaggggaccgcggctgactataagtcgacacaatctgccatagatcagatcacgggaaaactgaacagactgatagagaagactaatcagcagttcgaactgatcgataacgagttcaatgaggttgaaaagcaaatcgggaacgtaatcaactggacacgagacagcattactgaggtgtggtcctacaatgcggaattgctggtggctatggaaaatcaacacacaatcgatcttgccgattcagagatggacaagctttacgagagagtaaagcgacaactgcgcgagaatgctgaggaggacgggactgggtgcttcgagatctttcacaagtgtgacgacgactgcatggcctctatccggaataatacttatgaccatagcaaatatagagaggaggccatgcaaaaccggatccagattgatccagtcaagctctccagcggttataaggatgtgattttgtggttcagttttggcgcttcatgcttcatactcttggccatcgtgatgggcctggtgtttatttgtgtgaagaacggaaacatgcggtgtacaatttgcatc

SEQ ID NO: 583 - DNA, 1680 bp, Influenza A virus
  misc_feature (1)..(1680): Codon Optimized Sequence Encoding H7 Hemagglutinin
atgaatacccagatcctcgttttcgctctgatcgcaatcattcccacaaacgcagataaaatctgtctggggcatcacgctgtgagcaacggcacaaaagttaacaccttaaccgagcgcggcgtggaggtggttaatgctaccgagaccgtcgaacggaccaatatccccaggatctgtagtaaaggcaagaagacagtcgacctggggcagtgtgggctcctcgggactatcacaggaccccctcagtgtgatcagttcctcgagttctcagcggaccttattatagaacgccgagagggttctgatgtgtgttaccccggcaaatttgtgaacgaggaggctctgaggcaaattctgcgcgaaagcggcggcattgaaaaggaagctatggggtttacatactccggaataagagccaatggcgcgacttctgcttgtcgaaggtccggaagctccttttatgcggaaatgaaatggctattgagcaataccgacaatgctgccttcccccagatgaccaagagttataaaaatacccgaaaaagccccgcgcttatcgtttggggcatccatcattctgtttctacagccgaacagactaagctttatggcagcgggaataagctcgtgaccgtcggctcaagtaactatcagcagtcattcgtgccttccccgggggctagacctcaagtgaatggattatccggacgaatcgacttccattggttgatgttaaaccctaatgatactgtgaccttctccttcaacggggccttcattgctccagatcgtgctagtttcctgcggggcaagtccatgggtattcaatccggagtccaggtcgacgcaaactgtgagggggattgctaccactccggaggcacaattatttctaatctgccatttcagaacattgactcccgcgccgtggggaaatgtccaaggtatgtgaaacaacggagcctactgctcgccaccggaatgaagaacgttcctgaaatacctaaaggtcggggtttgtttggggctatagccggcttcatagaaaacggatgggaaggcctgatcgatggctggtatggctttaggcatcaaaatgcacagggggagggcactgcggctgactataagagcacccagtcagcgattgaccagattactggcaagctgaatagacttatagaaaagacaaatcagcaattcgagctgatagacaacgaattcaatgaggtggagaaacaaattggtaacgtcattaactggactcgtgactctattacggaagtgtggagttacaatgctgagctcctcgtcgccatggaaaaccaacacactatagatttggccgatagcgagatggacaagctgtacgagagggtaaaacgccagttgagagaaaacgccgaggaagatggcaccggttgctttgagattttccacaagtgcgatgatgactgcatggcaagcatcagaaataacacatacgatcatagtaaatacagggaggaagccatgcaaaaccgcattcagatcgatcccgtcaagctctcttcggggtacaaagatgtcatcctttggttctcattcggcgcatcttgctttatcctgctggctatagtgatggggctcgtgtttatttgcgtcaaaaatggaaacatgcgctgtaccatctgtatt

SEQ ID NO: 584 - DNA, 1680 bp, Influenza A virus
  misc_feature (1)..(1680): Codon Optimized Sequence Encoding H7 Hemagglutinin
atgaatactcagatcctggtgtttgcgctcattgcgatcatcccaaccaacgccgacaaaatatgtctgggacatcacgccgtttccaacgggacgaaggtgaacacgttgacagagcgcggagtggaggtcgtgaatgctactgagaccgtggagaggactaatatcccgaggatctgcagtaagggcaagaagactgtcgacttaggacagtgtggcctgttaggcacaatcacaggcccccctcaatgtgaccaatttctggagttttctgccgacctcataatcgagcgcagggaaggctccgacgtgtgctatccgggaaagttcgtcaacgaggaagccctcagacagatccttcgcgaatccggcggcatagataaggaagctatgggtttcacatattcaggaatccgcacgaatggcgcaacttccgcttgccggcgatcaggatcctctttctacgcagagatgaagtggctgctgagcaataccgacaatgccgccttcccccaaatgacaaagtcatacaagaatactcgtaaatcacctgccctgattgtgtggggaatccatcactcagtgtccacagcggagcagaccaagctgtacggaagcggtaacaagcttgttaccgttggctctagcaattatcagcagagctttgttccttcacctggagccagacctcaagtaaatgggcaaagcggtagaatcgactttcactggctgatgctgaatcccaatgacacagtcaccttttcgtttaacggcgcgtttatagcacccgatagggccagttttttgagaggaaagtcaatgggaatccaaagcggcgtgcaagtcgatgccaattgtgagggcgactgttaccatagtgggggaaccattataagtaatttaccctttcagaatattgactcaagggctgtgggaaaatgtcccaggtatgtcaagcagagaagcctgctgctggccaccggtatgaagaacgtacccgagattccaaaaggcagaggactgtttggagcaattgctgggttcatcgagaacgggtgggaggggcttattgatggctggtacggatttagacatcaaaatgcacagggggaaggcactgccgctgattataaaagtacgcagtccgcgatagaccagattaccggaaagttgaaccggctgatcgagaaaactaatcagcagtttgagttgatcgacaacgaatttaacgaggtggagaaacaaatcggcaatgtgattaactggactagagactccattaccgaggtgtggtcatataacgccgaattgctcgtggccatggaaaaccagcacaccatcgatctcgctgatagcgagatggacaaactctacgaaagggtcaagagacaactccgagagaacgccgaggaagacgggactgggtgttttgagatctttcataaatgtgatgacgactgtatggcttctatccggaataacacatacgaccactccaaatatcgggaggaagctatgcaaaatcgtattcaaattgatcccgtcaagctgagctccgggtataaggacgttatcctctggttctcctttggcgcttcctgtttcatccttctggctattgtcatggggctcgttttcatatgcgttaagaacgggaatatgcggtgtacgatctgtata

SEQ ID NO: 585 - DNA, 1680 bp, Influenza A virus
  misc_feature (1)..(1680): Codon Optimized Sequence Encoding H7 Hemagglutinin
atgaacacacagatattggtgtttgctttgattgcaatcattcctacaaacgcggataaaatctgcctgggccaccatgctgtgagtaacggcaccaaagtgaatactttaactgaacgcggtgtcgaggttgtgaacgcgactgaaacggtggagcgcacgaatattccccggatctgcagcaaaggcaaaaagactgtcgaccttggtcagtgcgggctacttgggactatcactggacccccacagtgtgatcaattcctggaattttcagccgatttgattattgagcggagagagggatccgacgtgtgctatccaggcaagtttgtgaacgaggaggcattgcggcagattctcagggaatctggaggcattgataaggaagctatgggtttcacctatagcggtatccggaccaacggagctaccagcgcgtgccggaggagcggtagctccttttacgcggagatgaagtggttgctctctaacacggacaacgccgccttcccacagatgaccaagagctacaagaacacccgcaaatcacctgccttaattgtgtggggcattcatcatagtgtctctacggccgagcagacaaaactgtatggatctggcaataagcttgtcaccgtcggcagctccaattaccagcagtctttcgtacccagtcccggtgcaaggccacaggtcaacggacagtcggggcggattgacttccactggctgatgctcaaccctaatgatactgtaaccttcagcttcaatggcgcattcatagctcccgatcgggcatcattcctgcgaggtaaatctatggggatccagtccggcgtgcaggtggatgccaactgcgagggcgattgctatcacagtggtgggacaatcatctctaatttacccttccagaatattgatagccgagctgtggggaaatgcccaaggtacgtcaagcagcgttcgcttctgttagccactggcatgaaaaatgtgccagagatacccaaaggcagggggttatttggagcaattgccggttttattgaaaatggctgggagggactcatcgacggctggtatggcttcagacaccaaaatgcccagggtgaaggtaccgccgccgactacaagtccactcaaagtgcaattgaccaaataactggaaagctgaaccggctgatcgaaaagacaaatcagcagtttgagttaatcgataacgagttcaacgaggtcgagaagcagattggaaatgtcattaactggacaagggattccatcactgaggtgtggagctacaacgccgagctgctcgtcgcaatggagaaccagcatactattgacctggcagactctgaaatggataaattatacgaacgcgtgaaacgccagctcagagaaaatgctgaagaggacgggaccggttgttttgagatttttcacaagtgcgacgacgattgcatggcctccattaggaacaatacatacgaccatagtaagtatcgagaggaagccatgcagaacaggatacagatagaccctgttaaactgtcctccgggtacaaggatgtgatcctttggttttcttttggggcatcctgctttattctgctggcaatcgtcatgggccttgtttttatctgcgtaaagaatggaaatatgagatgcacaatctgtatc

SEQ ID NO: 586 - DNA, 1680 bp, Influenza A virus
  misc_feature (1)..(1680): Codon Optimized Sequence Encoding H7 Hemagglutinin
atgaacacccagatccttgtattcgcattaatagctatcattccaacaaacgcggacaaaatttgcctggggcaccatgcagtctccaacggcactaaggtgaatacgctcaccgagcggggcgtggaggttgttaatgcgacggagacggttgagcggacgaatatcccccgaatttgttcgaagggaaaacggacagtggacctgggtcagtgtgggttgctgggtaccattacaggccccccccagtgtgatcagtttctggaattttccgccgaccttattatcgagcggagggaagggtccgatgtctgttacccagggaagttcgttaacgaggaggctttgcgccagatactccgggagagtggtggtattgacaaggaggccatggggttcacctacagcggcatcaggactaatggagccacctcggcctgtagaagaagtggatcttctttctatgccgagatgaaatggttgctatctaacactgacaacgccgcctttccacagatgactaaaagttacaaaaatacacggaaaagcccagccttaatagtctggggcatccatcatagtgtgtccaccgccgaacagactaaactatatgggtccggaagcaagcttgtgacggtgggctcttccaactaccagcagagttttgtgccctcccccggagcacggcctcaggtcaacggcttgagcggacggatcgactttcattggttaatgctgaatccaaatgatacagtaacattttcatttaatggcgccttcattgctccagacagagctagtttcttacggggcaaatcaatgggcatccagagcggggttcaggtggatgccaactgtgaaggagattgttatcacagcggcgggactatcatttctaatctcccatttcagaatatcgattcacgggcagttggcaagtgcccgagatacgtcaagcagcgatctctccttctcgcaaccggaatgaaaaacgtcccagagattcctaaaggcaggggcctgttcggcgccatcgccggatttattgagaacgggtgggaggggctgatagatggctggtacggctttcggcatcagaatgcacagggcgagggtacggctgcggactacaaaagtactcaaagcgcaatcgaccagattacaggaaagctgaaccggttaattgaaaagacaaaccagcaattcgagctcatcgacaatgagtttaatgaagtggagaagcagatcggcaatgtaatcaactggaccagagatagtatcactgaagtgtggtcctacaacgccgagcttctggtggctatggagaaccagcatactatcgatcttgcggatagcgagatggataagctgtacgagcgtgttaagcgacagctaagagagaacgcggaggaggacggtactgggtgtttcgaaatttttcacaagtgcgatgacgattgtatggcgtctatccgcaataatacttatgatcatagtaagtatcgggaagaagctatgcagaaccgcatccaaatcgaccccgtgaagctttcaagcggttacaaagacgttatcttgtggttcagcttcggggcgtcttgctttatcctgctggcgattgtaatgggcttggtctttatctgtgtgaagtccagaaatatgagatgcaccatttgtatc

SEQ ID NO: 587 - DNA, 1680 bp, Influenza A virus
  misc_feature (1)..(1680): Codon Optimized Sequence Encoding H7 Hemagglutinin
atgaatacccaaatcctcgtgttcgctttaatcgcaatcatcccgaccaatgccgacaagatctgcctgggtcaccacgctgtctccaacggcactaaggtgaacaccttaacagagagaggcgtggaagtagttaatgctaccgaaaccgtggaaaggaccaacattccgcggatatgttctaagggaaaacgcaccgtagatctcggccagtgtggactgctgggcacaatcaccggtcctccacaatgtgatcagtttcttgagttctcggccgacctcatcatcgaaaggagggaaggatctgatgtgtgttatcccgggaagttcgtgaaagaagaggccctgcgtcagatattgcgagagagtggcgggatagataaggaagcaatgggcttcacatacagcggcatcagaacaaatggcgcgacatccgcctgtagaaggtctgggtctagcttctacgcagagatgaaatggctgctcagtaacacggacaatgcggccttcccccagatgactaaaagctataaaaatacaaggaagagccccgccttgatagtgtggggaatccatcatagtgtgagtaccgctgaacagacgaagctatacggatcaggcaacaagctggttactgtcggcagttctaactaccagcaatcctttgtgccttctcccggcgcccgcccacaagtgaatggactatctggcagaattgatttccactggctgatgctgaaccccaatgacactgtgactttcagctttaacggagcctttatcgcccccgatagagccagtttcctgaggggcaaatccatgggcatccagtcaggcgtgcaggtcgatgccaactgcgagggagattgttaccattcgggtggcaccataattagtaacttaccattccagaatattgacagcagagccgttgggaaatgccccaggtatgtcaagcagaggtccctactactggccacaggcatgaagaatgttcctgaaattcctaaaggccgtggtcttttcggagcaatcgcaggattcatcgaaaacggctgggaaggactgattgatgggtggtatggttttaggcaccaaaatgcacagggcgagggcacagctgcagattacaagagcactcagtcagctattgatcagattaccggaaagcttaacaggctcatcgaaaagactaatcagcagtttgaactgatcgacaacgaattcaacgaagtagagaaacagattgggaacgtgattaattggacccgagactctatcacagaggtgtggagttacaacgcagagttgctggtagcaatggaaaaccagcacacaatcgatctcgcagacagtgagatggataaactttacgaaagggtcaaacgtcagttaagagagaacgcggaagaggatggcaccggttgctttgaaattttccacaaatgcgatgacgactgcatggcgtctatcagaaataacacttacgaccatagtaagtatcgggaggaggctatgcagaaccgaattcagatcgatccagtaaagctcagcagcggctacaaggacgtcatcctttggttctctttcggggccagttgcttcatccttctcgctatagtcatgggcctcgtgtttatctgcgtaaaaaatgggaacatgaggtgcaccatttgcata

SEQ ID NO: 588 - DNA, 1680 bp, Influenza A virus
  misc_feature (1)..(1680): Codon Optimized Sequence Encoding H7 Hemagglutinin
atgaatacacagatattggtcttcgctctcatcgctatcattcccaccaacgctgacaaaatctgtttaggccaccatgccgtatccaatggcactaaggtcaacacacttactgagcgaggcgtagaggtcgtcaacgctacagaaactgttgagcgaaccaacatccccaggatttgctctaaggggaaaaagactgtagaccttgggcagtgtggcctgctggggactatcaccgggccacctcaatgtgaccaatttctggagttctcagctgatctgattatcgagaggcgcgagggatctgatgtctgttacccaggtaagttcgtcaatgaggaggcgctccgccagatcctccgcgagagtggcgggatcgataaagaggccatgggcttcacttactccggcatcaggaccaatggcgctacatccgcctgtagacggagcggatccagcttttacgccgaaatgaagtggctgctgtccaacacagacaacgctgcttttccacagatgacaaagtcttataaaaatacccgcaaatctcctgccctgattgtgtggggcattcaccactcagtgtccactgccgagcagactaagttgtacggaagtggcaacaagctggtgacggtcggctcttcaaactatcaacagagctttgtaccttccccaggggcccggccacaggtgaacgggcagtcaggaaggattgatttccactggctgatgctgaatccaaatgatactgtcaccttcagctttaatggagcttttattgccccggatcgcgcatccttcctgcgcgggaagagtatggggatccagtccggggtacaagtcgacgctaactgcgaaggcgattgctaccatagcggaggaaccatcattagtaacctcccctttcagaatattgattcccgtgccgttgggaaatgtcccagatacgtcaagcagaggtccttgctgctcgcaaccggcatgaagaatgtgccagagattccaaaggggagaggtcttttcggtgctatcgccggctttatcgagaacggctgggaagggctgatcgatggctggtacggattccggcatcaaaacgcgcagggagagggaactgcggccgactacaagtcaactcagtctgccatcgatcagattactggtaagcttaaccgtctcatcgagaaaaccaaccaacaatttgaattaattgataacgagtttaacgaagtggagaagcaaattgggaatgtcataaactggacacgggattctatcaccgaggtatggtcttacaacgcggagttgctggtcgccatggagaaccaacataccatcgatctggctgacagtgaaatggacaagctgtatgagcgggtgaaacggcagctccgggagaatgcagaggaagacggtactggctgtttcgagatcttccataagtgcgacgatgactgtatggcctcgattaggaacaacacctatgatcacagcaagtatcgcgaggaagcgatgcagaaccggattcagatcgacccagttaaactctcgtcgggctacaaggatgtaatcctgtggtttagcttcggagcgtcgtgtttcatcttgttggcgatagtaatgggccttgtttttatctgcgtgaagaacggaaatatgagatgcactatctgtatt

SEQ ID NO: 589 - DNA, 1680 bp, Influenza A virus
  misc_feature (1)..(1680): Codon Optimized Sequence Encoding H7 Hemagglutinin
atgaacacgcagatcctagtgttcgcacttatcgccatcatccctaccaatgctgacaaaatttgcctgggacatcatgcggtttctaatggaaccaaggtgaataccctaacagaacggggggtggaagttgtcaatgccacagaaacggttgagcgtactaacattccccgcatttgctccaaaggaaaaaaaactgtggatctgggccagtgtggacttctgggcactattaccggccctcctcagtgcgaccagttcctggagttctctgcggaccttattattgagagacgtgagggatctgatgtgtgttatccagggaagttcgtaaacgaagaggctcttagacaaatcctgcggaagagcggtggcatagataaagaggcaatggggtttacatacagcggcataaggaccaacggcgccacatccacttgcaggcggtccgggtcgtcattttacgccgagatgaaatggttgttaagtaatacagacaacgcagcctttccgcagatgactaaatcttataaaaacacacgaaaatctccggcgatcattgtatggggcatacaccacagtgttagcactgccgagcagacgaaactatatggctccggaaataaactggtcaccgtaggatcctccaactaccagcagagcttcgtgccctcgcctggcgcacggccacaagttaatggtctcagcggtcggattgactttcactggctcatgcttaatcctaatgacacagtaaccttctcctttaacggcgccttcatagctcccgacagggcatgttttctgcgcgggaagagtatggggatccagtccggggtccaggtagatgcagactgcgaaggggactgctaccacagtgggggtaccatcattagtaaccttccctttcagaatattgacagcagggccgtcgggaagtgcccccgctacgtgaagcagcggtctttgctcctggctaccggtatgaagaacgtgcccgagataccaaaaggcagggggctctttggtgccatcgccggctttatcgaaaatggatgggagggcctcatcgacggttggtacggtttcaggcaccagaatgcccagggggaaggaacagctgcagattacaagtcaacccagtctgctattgaccagataacagggaaactgaaccgattaattgagaaaactaatcaacagttcgagctgattgataacgagtttaacgaggtggaacgccaaatcgggaacgtgattaactggacaagggattcaatcacagaggtttggagttataatgccgaactgctggtcgccatggagaaccagcacactatcgatctagctgattctgagatggacaagctctatgagcgcgtcaagcgtcagctccgcgaaaacgctgaagaagatggcactggctgtttcgagatcttccacaagtgtgacgacgactgcatggcctccataaggaataacacttatgatcacagcaagtatcgagaggaggccatgcagaaccgcattcagattgatcccgttaagttaagttctgggtataaagatgtcattctttggttctcttttggtgcttcatgttttatactgctggctatcgtcatgggactcgtgttcatctgcgtcaaaaatgggaatatgcggtgtaccatatgcatt

SEQ ID NO: 590 - DNA, 1680 bp, Influenza A virus
  misc_feature (1)..(1680): Codon Optimized Sequence Encoding H7 Hemagglutinin
atgaatacgcagatcctggtgttcgctctaatcgctattatccctacaaacgcagataagatctgtttaggccaccatgcagtttctaatggcactaaggtcaacactctcactgaacgcggggtggaggtagtcaacgctacagagacagttgaacgaacaaacatccccaggatttgctctaagggtaaaaaaacagtggacctgggacagtgcggactgctcgggaccattactgggccacctcagtgtgaccagttcttggagttttccgccgatctaatcatcgaaagacgagaaggatccgatgtgtgctatcctggcaagtttgtgaatgaggaagcactgcggcagatcttgcgggagtctggcggaattgataaggaagcaatgggttttacctactccggtattcggacaaatggagctacatccgcatgtcggcggtccggaagcagtttctacgccgagatgaagtggctattgtcaaacacagataacgctgccttcccccagatgactaagagctataagaacacccggaagagccctgccctgatcgtctggggcattcatcattcggtcagtacagccgaacaaactaagttgtacggctccggaaacaagttggttacagtggggtcttccaactaccagcagagctttgtaccttcccccggagcccgaccccaggtcaacggccagtctggaagaattgattttcattggctaatgctgaatcctaatgatactgtgacattttcattcaatggagccttcatagcacctgatagggcctctttcctgcggggaaaaagcatgggtattcagagtggcgttcaggtggatgctaattgcgagggggactgctatcatagtggtgggaccattattagcaacctcccctttcagaatatagatagcagggctgtcggcaaatgtccaaggtacgttaagcagcggagtctactgttggccaccggtatgaaaaacgtccccgagatccctaagggacgcggcctgttcggcgccatcgccggatttatcgagaacgggtgggaaggcttgatcgatgggtggtatggattccgacatcagaacgcccagggcgaaggtactgctgccgactataaatctacgcagagcgcaatagaccagattacggggaaactgaacaggctgatcgagaagaccaatcagcagtttgagctgattgacaatgaattcaacgaagttgagaaacagatcggtaacgtgataaattggactagagatagtatcaccgaggtatggagctacaacgccgagctgcttgtcgctatggaaaaccagcacaccatcgaccttgctgacagtgagatggataaactctatgaacgagtgaagagacagttgcgggaaaacgccgaagaggacggtaccgggtgctttgagatatttcacaagtgcgatgatgactgtatggctagtatccgcaataatacatatgaccatagtaagtacagagaagaagccatgcaaaacagaatacaaattgaccccgtgaagttaagctcaggatacaaagatgtcatcctttggttctccttcggcgcatcatgctttatacttctcgcaatcgtgatgggtctggtttttatatgcgtcaagaacggcaatatgcgctgtacgatctgtatt

SEQ ID NO: 591 - DNA, 1680 bp, Influenza A virus
  misc_feature (1)..(1680): Codon Optimized Sequence Encoding H7 Hemagglutinin
atgaacacccagattctggtttttgcattgatcgccattattccgactaatgccgacaaaatctgtttgggacaccacgccgtgagcaacggcacgaaagtcaacacactcacagaacgaggcgtggaagttgtcaacgcaaccgagacggttgagcgcaccaacatcccaaggatctgctctaagggcaagaagaccgtggaccttgggcagtgtggcctgctggggacaataaccggtccaccacaatgtgatcaattcctggagttttcagccgacctcatcatagaacgccgggaaggttctgacgtgtgctacccgggcaaatttgtcaacgaggaggctctcaggcagatcctgagggagtcaggcggaattgacaaggaagccatgggtttcacgtacagcggtattcggaccaatggggctacatcagcctgtcgcagatctggaagttctttttacgctgaaatgaagtggctgctgtcaaataccgataacgctgcatttccccagatgacaaaaagttataagaataccaggaagtcccccgccttgatcgtgtggggcatacaccactcagtgagtacagccgagcagaccaagttgtatggatcgggtaacaaactagtcaccgtgggctccagcaattatcagcagagttttgtccccagccccggggctagaccgcaagtcaatggtcagtccggccgtatcgattttcactggctgatgctaaatcccaatgacactgtaaccttttcctttaatggggcattcattgcacccgacagggcatcctttttgcggggtaagagtatgggtatccagagtggcgtccaggtggatgcaaactgcgagggtgactgctaccattcaggaggcacgattatatcaaatctgccctttcagaacattgacagtcgcgccgttggcaaatgtccaaggtacgtgaagcagagaagcctcctgctcgccactggcatgaaaaatgtgcccgagattcccaaaggccggggtctttttggcgcaatagctggttttatcgagaatggttgggaaggactcatcgacggctggtacggatttcggcaccaaaacgcccaaggggaaggaaccgccgcagattacaagagcacgcagtcagctatcgaccagatcaccggcaagcttaatcggcttattgaaaaaaccaatcaacaattcgagctgattgacaatgaatttaatgaagtggagaaacaaattgggaacgtgatcaattggaccagagacagcataactgaagtgtggagttataacgcagaactgctggtcgctatggaaaatcaacacactattgatctggccgatagcgaaatggacaagctatacgaaagggttaaacggcagcttcgcgagaacgccgaggaggacggcaccggctgcttcgagattttccacaagtgtgatgacgattgtatggcctccatcagaaacaacacctacgaccatagcaagtatagagaagaagccatgcagaatcgcatccagatcgaccccgttaagctttcatccggctataaggacgttatcttatggttctcttttggagcatcatgctttatcctcctggctatcgttatgggccttgttttcatctgcgttaaaaacgggaatatgcgctgcaccatctgtatt

SEQ ID NO: 592 - DNA, 1680 bp, Influenza A virus
  misc_feature (1)..(1680): Codon Optimized Sequence Encoding H7 Hemagglutinin
atgaatacacagatcttagtgtttgctcttatagcaatcatacccacaaacgccgataagatctgtctggggcaccatgccgtgagcaacggaactaaggttaacacattaactgagagaggtgtggaggtagttaacgcgaccgagactgtagagcggactaatatccctcgcatttgcagtaagggcaaaaagaccgttgaccttggtcagtgtgggctgcttggaaccatcaccggacctcctcagtgtgaccagttcctcgaattttccgctgacctgattattgagagaagggaagggagtgacgtgtgttatcctggcaaattcgtcaatgaagaagcgctacgccagatccttagagagagtgggggaatcgataaggaggcaatgggctttacatacagtggcataagaaccaatggcgcgacaagtgcctgccgccggagcggctcaagtttctatgctgagatgaaatggttactcagtaatactgataatgccgcatttccacagatgactaaatcttataaaaatacacggaaatcacccgcactgattgtatggggtatccaccacagcgtctccacagcggagcaaacaaaactgtacggcagtgggaacaaattggttactgttgggtcctcgaattatcagcagtctttcgtccctagccctggagctcgcccccaagttaacggtcagagcggcaggatagatttccactggttaatgctaaaccctaatgacaccgtaaccttttcgtttaatggagcattcattgcgcctgaccgcgcgagcttcttaaggggaaagtcaatgggaattcaatctggggtccaagtcgacgcaaattgtgagggcgactgctaccactcaggaggaactatcatctcgaacctgccttttcaaaacatcgatagcagagccgttggcaagtgccctcgctatgtgaaacagcgctcacttctcttagcgacgggaatgaagaacgttccggagatcccaaagggtcgtggcttgtttggcgcaatagcagggttcatagagaacggatgggaaggtctgattgacggttggtatggcttcagacaccagaatgctcagggagaaggaaccgcagccgattataaatcaacacagagcgccatagatcagatcacaggaaagttaaatcgcctgatcgagaagacgaatcagcagttcgagctgatcgacaacgagttcaacgaagtcgagaaacaaattggcaacgtgatcaactggacgagggatagcattacggaggtgtggtcttataacgctgaactacttgtggcaatggagaaccagcatacaatcgacctcgctgactcagaaatggataagctgtacgagagagttaaacggcagttgagagaaaacgcagaggaggatggcacaggctgctttgaaatttttcacaagtgcgatgatgactgcatggcttccattcggaacaatacgtatgaccactctaaatacagggaagaggccatgcagaatcgcatccagatcgatcctgtaaagttgtcctcaggctataaagatgtgatcctctggttttcctttggggcatcatgtttcattctgctcgccatcgtgatggggctggtgttcatttgtgttaagaacgggaatatgcggtgcactatctgtatt

SEQ ID NO: 593 - DNA, 1680 bp, Influenza A virus
  misc_feature (1)..(1680): Codon Optimized Sequence Encoding H7 Hemagglutinin
atgaatacgcagatactcgtgtttgccctgatcgccataatccctacgaacgcagataagatctgcctcggacaccacgctgttagcaacggaaccaaggttaacactttgacggagaggggagtggaggtcgttaatgccaccgaaaccgtggaacgtaccaacatcccccggatctgttccaaaggtaaaaagactgtcgatctgggacagtgcggcttactgggaactattactgggcccccgcagtgtgaccaattcctggaattctctgcagatcttattattgagcggagggaggggagcgacgtctgctatccggggaagttcgtcaacgaggaggccttgagacagatcctgagagaatctgggggcatcgataaagaagccatgggatttacttatagcggcataagaaccaatggcgccacatccgcctgccgtaggagtggctcaagtttttatgcagaaatgaaatggctactcagcaatactgacaacgctgccttcccccagatgacaaagagctataagaataccaggaagtcaccagccctgatcgtttggggcatacaccattccgtatctaccgcggagcaaacaaagctttatggctctgggaataagcttgtaactgttggcagtagtaattatcagcagagctttgttccatcccctggcgcccggccccaggtgaatggtcaaagcggcaggatagactttcactggctgatgctcaaccccaacgatactgtgacattctcctttaacggagccttcattgctcccgaccgcgcctctttcctcaggggcaaaagtatggggattcagtcaggtgttcaggtggacgcaaactgcgaaggcgattgctaccactcgggggggacaatcatatccaacctgcccttccagaacattgacagtcgcgccgtgggtaaatgcccacggtacgtgaaacagcggtccctgctactggctactgggatgaaaaacgtccctgagattcccaaaggccggggactgtttggcgctatcgcggggttcatagagaatgggtgggagggcttgatcgacgggtggtacggttttagacatcagaacgcgcaaggggaggggactgctgcagattacaagtcgacacagtccgcaatcgaccagatcaccggtaaattgaaccggctgatagaaaagaccaaccagcagtttgagttgatagacaatgaattcaatgaggtcgaaaaacagatcggtaatgtgattaattggactcgggattcaattacggaagtatggtcttacaacgcggagttgttagttgcaatggaaaaccagcacacgatcgatcttgcagactctgaaatggataaattatacgagcgggtcaaacgccagcttcgggaaaacgccgaagaggatggtactggatgttttgagatctttcataaatgcgacgacgattgtatggccagcattcggaacaatacttacgaccattcaaagtaccgggaggaagccatgcagaatagaatccagattgatccagtgaaactcagctcgggatacaaagatgtgattctgtggttctccttcggggcctcttgcttcatactgctggctatcgtaatggggcttgtcttcatatgtgtgaaaaacgggaatatgagatgcaccatttgtatc

SEQ ID NO: 594 - DNA, 1680 bp, Influenza A virus
  misc_feature (1)..(1680): Codon Optimized Sequence Encoding H7 Hemagglutinin
atgaatactcagatactcgtttttgctttgatagccatcattccaactaacgctgacaaaatctgcctaggacaccatgcagtgtcaaatggcacaaaggtgaatactttgacggagaggggcgtggaggtggtgaacgcaacagagacagtggagcgcaccaacattccacgcatttgtagtaaaggaaagaagacagtcgacctcggccagtgcgggctactgggtacgattactggacccccccagtgtgatcagtttcttgagtttagcgcggatctgataattgagcgccgggagggttccgatgtctgttaccccggaaagtttgtgaacgaagaagcccttaggcaaatcctgcgcgagagcggcggaattgagaaggaagctatggggttcacgtatagcggtattcgggctaacggagccactagtgcatgtcgccgcagcggctcctcattctacgctgagatgaagtggctgctgtccaataccgacaatgctgcttttccgcagatgactaagtcatacaaaaacactagaaagtcgcccgctttgattgtttggggcatccaccacagcgtgagtacagctgagcagacaaagctatatggttcagggaataaattagttaccgtgggcagctctaactaccagcagtcctttgtgccctctcccggcgctcggcctcaggtaaatgggcttagcggccggatcgactttcattggctgatgctcaaccctaatgacacagtgacgttctctttcaatggcgcgttcattgcccccgacagggcttctttcctacgggggaaaagcatgggtattcagtcaggtgttcaagtagacgcaaactgtgaaggagactgttaccacagcgggggcacaatcatttcaaatcttcctttccagaacatagatagccgggcagtcggtaaatgccctcggtatgtgaaacaaagatccctgttgctagcaacaggcatgaaaaacgtcccagagatccctaagggacgcggacttttcggcgcgatcgcgggatttatcgagaacggctgggaaggcctaatcgatggatggtatgggtttaggcatcagaatgctcagggggagggaacggctgcagattataaatctactcagtctgctatcgaccaaatcactgggaagctcaataggctgattgaaaaaacaaatcaacagttcgagctgatagacaatgagttcaacgaggtagagaagcagataggtaacgtaattaattggactcgcgactccattacagaagtgtggtcctacaatgctgagctgcttgtggcaatggaaaaccagcacaccatagacctggctgattcagaaatggataaactgtatgagagggtgaagaggcagctccgggaaaacgctgaggaagacggcacaggttgcttcgaaatttttcataagtgcgatgacgactgtatggcttcaattcgaaacaatacatacgaccactccaagtatcgagaggaagccatgcagaatcgtatccaaattgatcccgttaaactatcatccggatataaagacgtcatcttgtggttttccttcggggcctcttgtttcatcctcctcgcaatcgttatgggattggtgtttatctgcgtgaaaaacggcaacatgcggtgcacaatatgcatt

SEQ ID NO: 595 - DNA, 1680 bp, Influenza A virus
  misc_feature (1)..(1680): Codon Optimized Sequence Encoding H7 Hemagglutinin
atgaacacccagatcttggtgttcgccctcattgctattataccaactaatgcggacaaaatctgccttggacaccatgccgtatccaatggaaccaaggtcaatacactgacggagaggggagtggaagtagtgaacgccacggaaacagtggaaaggacaaatatccctaggatttgctccaaaggcaaaagaacagtggacctggggcaatgcgggcttttgggtactattacaggaccacctcagtgcgaccaattccttgagttcagcgctgatctgattatagagaggcgcgaggggagtgatgtttgctaccccggtaagttcgtaaatgaggaggctctgcggcagatcttacgcgaaagcgggggcattgataaggaagctatggggtttacctacagcggcattcgcactaatggcgcgacatctgcctgtcgccgttccgggtcatctttctatgcagagatgaaatggctgctctccaatactgataatgctgctttccctcaaatgacaaagtcttacaagaatacaaggaagtctcccgcactgattgtgtggggcatccaccacagcgtctcaaccgctgagcagactaaactgtatggttctgggaacaagctcgtgaccgtcggatcgtctaattatcagcagagcttcgtcccatcacctggcgccagaccccaagtgaacggtctgtccggcagaattgatttccactggctgatgctgaatcccaatgacacggtcacattctcatttaatggcgcattcattgccccggatagagcttcctttctcaggggcaagtctatgggaattcagagcggtgtccaggtggacgcgaattgcgaaggggactgctatcactccggcggcaccatcatttctaacctcccttttcagaatattgacagtcgcgccgtcgggaaatgccctcgctacgtgaagcagagatcactgctcttggccacaggaatgaagaacgtgcccgagatcccgaaagggagagggctcttcggagccatcgctgggttcattgaaaacggatgggaaggcctgatagacggctggtacggcttccggcaccaaaacgcccagggggaaggaacagccgctgactataaatctacacagagcgcgatagaccagatcaccggcaaattaaatcgtctcatcgaaaaaacaaatcagcagtttgagcttatcgataatgaattcaacgaggttgaaaagcaaatcgggaatgttataaattggacccgagactccattaccgaggtgtggagctataacgccgagctgttggtggccatggagaaccaacatacaattgatttggccgactccgagatggacaagctgtatgagcgggttaaacggcaactgcgtgagaatgcagaagaagacggcactggctgcttcgaaatcttccacaagtgcgatgatgattgcatggcttcaatacgcaataacacatacgatcacagcaaatacagggaggaagctatgcagaatcgcatccagattgatccagtgaagctgtcatccggatacaaagatgttatattatggttctcctttggggcttcctgtttcatcctgctggcaatcgtgatgggcctagtgttcatatgcgtcaagaatggaaacatgagatgcaccatctgtatc

SEQ ID NO: 596 - DNA, 1680 bp, Influenza A virus
  misc_feature (1)..(1680): Codon Optimized Sequence Encoding H7 Hemagglutinin
atgaatacccagatacttgtatttgcccttatcgccataatccccactaacgccgacaagatttgtctagggcaccatgcagtatctaatggaacaaaagtgaataccctcacagaacggggtgttgaagtggttaatgccaccgaaacagtcgagagaactaacattcccaggatttgtagcaagggtaagaagacagttgaccttgggcagtgtggcttacttggaactattaccggcccaccacagtgcgatcagtttctggagttcagcgcagatctcattattgagagaagagaaggaagcgacgtgtgctaccctggcaagttcgtgaatgaggaggcccttcggcagatccttagggagtccggaggcattgataaggaggctatgggttttacctattctggcattcgtaccaacggggccacaagtgcttgtcgccgctccggttcttccttttacgctgagatgaaatggttgctcagcaacactgacaatgctgctttcccacagatgacaaaatcctacaaaaataccagaaaatcgcccgccttgattgtgtgggggatccaccatagtgtgtctaccgctgagcagaccaagctgtatggttccgggaataagctcgtgaccgtaggttcttccaattatcagcagagtttcgtgccttcccccggcgccagacctcaggtgaatggccagagcgggagaatagacttccattggctcatgctgaaccctaacgatacagtgaccttcagtttcaacggcgccttcatcgctccagaccgcgcctcattccttcgcggcaaaagcatggggatccagtccggggttcaagtagacgccaactgcgagggtgactgctatcactccggagggacgataatcagcaatcttcccttccagaacatcgatagccgcgccgtcggtaagtgcccacgctacgttaaacagcgcagcctgctcttggctaccggcatgaagaacgtccccgaaatccctaagggccggggcctgttcggggccattgcgggttttattgagaatggctgggaggggctgatagacgggtggtacggatttagacaccagaatgctcagggggaagggaccgctgccgattataagagcacccagtctgctattgaccagattacgggtaagctgaacagacttattgaaaaaaccaaccagcagtttgagcttatcgacaatgaattcaacgaagtggagaagcagatcgggaatgtcatcaactggacaagagatagcatcacagaggtctggtcatataacgccgaactgttggtggccatggaaaatcaacacactatagatctagccgactctgaaatggataagttgtacgagcgggtaaaacggcagctgcgggaaaacgctgaggaagatggcaccggatgcttcgagatttttcataaatgcgatgacgactgtatggcctctatcaggaataatacatacgatcatagtaagtaccgggaagaagccatgcagaacaggatccagatagatcccgttaagctgtctagcgggtacaaggatgtcatcttatggttcagcttcggcgccagctgcttcatcctattggccattgtcatgggactagtctttatctgcgtgaaaaacggtaatatgcggtgtactatctgtatc

SEQ ID NO: 597 - DNA, 1680 bp, Influenza A virus
  misc_feature (1)..(1680): Codon Optimized Sequence Encoding H7 Hemagglutinin
atgaatacccagatcctggttttcgcgctgatcgcaatcatacctactaacgcagataagatttgcttgggacatcatgccgtgtccaacggcacaaaagtcaataccctcacagagaggggcgttgaggtggtgaatgctaccgagactgtggagaggaccaatattccgagaatttgctcaaaaggaaagcgtacagtcgacctggggcaatgtggcctactcggcaccattacagggcccccccagtgtgaccagtttctcgaattttctgctgacctcatcatcgagagacgcgaggggtccgacgtgtgttaccctggcaaattcgttaatgaagaagccctaagacaaattctacgcgagagcggaggtattgacaaagaggctatgggattcacttattctggtatccgcaccaacggcgctacctccgcctgccggcgctccggatccagcttttatgctgagatgaaatggttgctgtccaacaccgacaatgctgcatttcctcagatgaccaaatcttataaaaacacaagaaagagtcctgcgttgattgtgtggggaatacaccactcagtaagcactgccgaacagacgaagctgtatggttccggaaacaagctcgttacagtgggcagttcaaattaccagcagagctttgttccttccccaggggaacgaccccaagttaatggactgtccgggagaattgatttccattggctgatgctgaaccccaacgacactgtgacgttctcctttaatggggcatttatcgccccggatagagcttcttttctgagaggcaagtcaatggggatccagtcaggggtgcaagtcgatgccaactgcgaaggagattgttatcactcaggaggcacgattattagcaatctgcccttccagaatattgattctcgcgccgtgggcaaatgtcctcgatacgtgaagcagagatccctgctgctggctaccggcatgaaaaatgtaccagagattccaaaggggagaggactgttcggtgccatcgccggtttcatagaaaatgggtgggagggcctgattgatggctggtacggttttaggcaccagaatgctcagggagaagggaccgccgcagattataaaagcactcagtctgcaatcgatcagataacaggtaaactgaaccgcctgattgagaagacaaaccagcagtttgaactgatcgataatgagtttaatgaagtggagaagcagattggcaacgttatcaactggacacgggactccatcaccgaagtgtggagctacaacgctgagctgctggtagccatggaaaatcagcacacaatcgatctggctgactcagaaatggacaagctctatgagagggtcaaaaggcaactaagagaaaatgccgaggaagatgggaccggctgtttcgagatatttcacaaatgcgacgatgactgcatggctagcattaggaataatacctacgatcatagcaaatatcgggaagaagctatgcagaaccgcatccaaatagatcccgtcaagttgagctctgggtacaaggatgtgattctgtggttctctttcggcgcctcttgctttattctgctggcaatcgtgatgggtctggtgtttatttgtgtcaaaaacggtaacatgcgctgcactatctgcata

SEQ ID NO: 598 - DNA, 1680 bp, Influenza A virus
  misc_feature (1)..(1680): Codon Optimized Sequence Encoding H7 Hemagglutinin
atgaatacacagattctagtgtttgccttgatagctataatcccaaccaacgcggacaagatctgtctcggacaccatgccgtgtcaaatggtactaaggtgaatacactgaccgaaagaggagtggaggtcgtgaatgcgacagaaacggttgagcgaaccaacattcctaggatctgtagtaagggaaagcgaactgtcgatctgggccagtgtggactcctcgggaccattacagggcctcctcagtgtgatcagtttttggaattttccgcagacttgataatcgagaggcgggaagggtctgacgtgtgctacccaggcaaatttgtaaatgaagaggccctaaggcagatcctgagggagagtggtggaatcgataaagaagccatgggatttacatattcaggcatcaggaccaacggcgcaacatcagcctgccgaagatcgggatcttcattctacgccgagatgaaatggttgctatccaacactgacaatgccgcattcccccagatgactaaaagctacaaaaacacccggaagtccccagctctcatcgtctgggggatccatcacagtgtgtccaccgccgagcagaccaagctgtatggatccggcagtaaactggttactgtggggtcatctaattaccaacagagttttgtgccatcgcctggcgccagacctcaagtgaatggactgtccggtagaattgattttcactggctcatgctgaaccctaatgacacggttaccttttctttcaacggagcatttatagctccggatcgcgccagttttctacgggggaaaagcatgggaatccagtcgggtgtgcaggtagatgctaactgcgaaggtgattgctaccactccggtggtacaatcatcagcaatctgccgttccagaacatagatagtcgtgcagtgggtaagtgccctaggtacgtgaaacaaagatctctgctgcttgcaaccggtatgaagaacgtgcctgagattccgaaagggcgcggcttattcggagctatagctggattcatcgagaatggatgggagggcctgattgatggttggtacgggtttcgacatcagaacgcccagggagagggtaccgctgctgactacaagagcacccaatccgctatcgaccagataactggcaagctgaatagactgattgaaaagacaaatcagcaatttgaattgatcgacaacgaattcaacgaagtggaaaagcagattggtaacgtgatcaactggaccagagactctatcacagaggtatggtcttacaatgccgagctcctggttgccatggaaaaccaacataccattgacttggccgacagcgaaatggataaactatacgagcgggtcaaacgacagctgcgcgagaatgccgaggaggatggaactggctgcttcgaaatcttccacaagtgtgacgacgattgtatggccagcatccggaacaatacatatgatcattcaaaatatcgcgaggaggctatgcagaatagaattcagattgaccccgtgaagctgagcagcgggtacaaggacgtcattctgtggttcagtttcggagcctcttgttttatcctcctcgcgatcgtgatgggattagtgtttatttgtgtgaagaacggcaatatgaggtgtacgatttgtatc

SEQ ID NO: 599 - DNA, 1680 bp, Influenza A virus
  misc_feature (1)..(1680): Codon Optimized Sequence Encoding H7 Hemagglutinin
atgaacacgcagatcttggtgttcgcactaatcgcgataatccccactaatgcagacaaaatttgtttaggccatcatgctgtatccaatggcacaaaagtcaacaccctgacggaaagaggtgtggaagtcgtcaacgctaccgagactgtggaacggacgaatatcccaaggatctgttcaaaggggaagcgaacggtcgacctgggacagtgcggcctgctggggaccatcacaggaccgccacagtgcgaccagtttctggagttttctgcggacttgattatcgaaagacgggagggaagtgacgtatgctatcccggcaaattcgtgaatgaagaggccttgcgccagatattacgcgagtccggagggatcgacaaggaagctatggggttcacatactccggcatcagaaccaacggcgccacatccgcatgccggcgcagtggatccagcttctacgcagaaatgaaatggctcctcagcaatacggataacgccgccttcccacaaatgaccaagtcatacaaaaataccagaaagagcccagccttgatagtgtggggaatccaccactctgtgtctaccgccgaacagactaagctgtatggatctggctcgaaattagtcaccgtcggctcctccaactatcagcaatcattcgtgccaagccccggagcccgcccacaggttaatggactgtcaggaaggattgacttccactggctgatgctgaatcctaatgatactgtgactttctcatttaatggcgcttttattgcccctgacagagccagcttccttcgagggaagtccatgggaatccagtctggcgtgcaagtagacgcaaactgtgaaggggattgctatcatagtggtgggacaatcatttcaaatctgcccttccagaatatcgatagtagagcagtaggaaaatgtcccaggtacgtgaaacagagatcactgttattggctacaggaatgaaaaatgtcccagaaatcccgaaggggagaggcctctttggggccatagcaggctttattgagaatgggtgggaaggcctaatcgatggatggtacgggttccgccatcagaatgcgcagggcgaggggactgcagccgactacaaaagcacgcaatccgctatcgaccagattactggaaagctcaaccgattaattgaaaagactaatcagcagttcgaactgatcgataacgagttcaacgaggtcgaaaagcagatcgggaatgtgatcaactggaccagggattccataaccgaggtttggagctataatgcagagttgcttgtagcaatggagaaccaacataccatagacctggccgattcggaaatggacaagctgtatgagcgagtgaaacggcagctgcgggagaatgcagaagaagacggcacaggttgttttgaaatttttcacaaatgcgatgacgattgcatggcatcgatcagaaataacacctatgatcattcaaagtatcgcgaggaggccatgcagaataggatccaaatcgaccctgtcaaactctctagtggctacaaggatgtcatcctctggttctcctttggtgcctcttgcttcattttgctcgccattgtaatgggattggtgttcatttgtgttaaatccagaaatatgcgttgtaccatttgtatc

SEQ ID NO: 600 - DNA, 1680 bp, Influenza A virus
  misc_feature (1)..(1680): Codon Optimized Sequence Encoding H7 Hemagglutinin
atgaacacccagattctggtcttcgctctgatcgccattataccaacaaatgcggataaaatttgcctgggacaccatgctgtaagcaacggcacgaaggtgaacacactcaccgaaaggggagtcgaagtagtcaatgccacagagaccgttgaacgtacgaacatccctagaatttgtagcaaagggaaacggactgtcgatttgggacaatgtggactgcttgggactatcacagggccccctcagtgcgatcagttcctggaattctcggccgatctgatcattgaacggagagaaggaagcgacgtgtgctacccaggtaaattcgtgaacgaagaggcactgcgccaaattcttcgggagtccggcgggatcgacaaggaggcaatgggatttacgtattctggcattaggaccaacggggctacatctgcctgccggcgaagtggatcctccttctatgcagaaatgaagtggctcctttcaaacacagacaatgccgcctttccacagatgaccaagagttataagaataccaggaaaagtcctgccttgattgtgtgggggattcaccactccgtgagcactgccgagcagaccaagctttacgggagcggcaataagctggtgacagtgggctcttccaattatcaacaatccttcgtgcctagccctggggaaagaccccaggtgaatggactgtccggccggatcgactttcactggctcatgctgaatcccaacgacactgtaacctttagctttaacggcgccttcatcgctcccgatagggcgtctttcctacgggggaaaagtatgggaattcaatcaggcgtccaggtagacgccaactgcgagggtgactgttaccacagcggaggtacaataatttccaacctgcctttccaaaacatagattcccgcgcagtggggaaatgccccaggtacgtgaagcagcgaagtctcctccttgccacaggaatgaagaacgtgcctgagattccaaaagggcgggggttgttcggggccatcgctggatttatcgaaaacgggtgggaaggccttatcgacggctggtacggttttaggcaccagaacgcacagggtgaggggactgcggccgactacaagtcgacacaaagcgctatagaccagatcaccgggaaacttaatcggctgatcgaaaagactaaccagcagtttgaattaatcgacaacgaatttaatgaggtggagaagcagatcggaaacgtgattaattggaccagggattccatcacggaagtttggtcctataacgcggagttgcttgttgccatggaaaaccagcacaccattgacctcgctgactctgagatggacaaactatatgagagagtcaaaagacagctgcgcgaaaatgcagaggaggatggcacgggttgtttcgaaatctttcacaaatgtgatgacgattgtatggccagtatacggaataacacctatgaccactcaaagtaccgagaagaagccatgcagaatcgcatccagatcgatcctgttaagctgtcctcaggatataaagacgtcatcctgtggttctcttttggcgcaagctgctttatccttttagcgatcgtgatgggcctggtttttatatgtgtcaagaatggaaatatgcggtgtacaatttgcatc

SEQ ID NO: 601 - DNA, 1680 bp, Influenza A virus
  misc_feature (1)..(1680): Codon Optimized Sequence Encoding H7 Hemagglutinin
atgaacactcagatcttagtgtttgcactgattgccataatcccaacaaacgccgataaaatctgcctgggccatcacgcggtgtcgaatggcacaaaggtcaacacactgaccgaaagaggcgtagaggtcgtgaacgcgacggagaccgtggagcgcactaacattcctcgcatctgttcaaaaggtaagaaaacagtggatttgggacagtgtggccttctcggtaccattaccggccctccccagtgcgaccagttcctcgaattttctgctgatttaattattgaacggcgggaggggtcagacgtgtgttatcccggcaagtttgtgaacgaagaagctcttagacagatcctccgggagagcggggggattgacaaggaagcaatgggctttacatactcaggtattcgaacaaatggagccactagcgcctgccgacgatccgggtcatctttctacgcagagatgaaatggctgctcagcaacactgataatgctgcctttccacagatgacaaaatcctataaaaacaccagaaaatcccctgcgttaattgtctggggcatccaccattcggtttctacagcagagcagaccaagctgtacggcagcggaaataaactcgtgactgtaggatcgagtaattatcagcaaagctttgttccatcaccaggggcccgtccacaggtcaatggacagagtggaaggatcgatttccattggctaatgctgaacccaaacgatactgtgaccttttctttcaacggggccttcattgctcctgatcgggcatcatttttgcgtgggaagtcaatgggtatacaatcaggggtgcaagtggacgctaattgcgaaggtgactgttaccattctggaggcaccattatctctaacttgcctttccaaaacattgacagcagagccgtgggtaagtgccctcgatacgtgaagcagcggtcgcttctccttgccacgggcatgaagaacgtgcctgaaatccctaaaggtcgtggtctattcggagcaattgccggtttcatcgagaatgggtgggaaggccttatcgatggttggtacgggtttcggcaccagaatgcccagggcgagggcacagctgctgactacaagtcgacccagagcgctatcgaccagatcacaggcaagctcaacaggctgatcgaaaagactaaccagcaattcgaattgatcgataacgagtttaatgaggtggaaaagcagattgggaatgttatcaactggacccgcgattccattactgaggtatggtcctacaacgctgagctcttagtcgctatggagaaccagcacaccatagatctggctgattcagagatggataagctctatgaacgggttaaaaggcagcttcgggagaacgccgaggaagacggaactggttgcttcgagatctttcacaaatgtgacgatgactgcatggcttccattagaaataacacgtatgaccatagcaagtatagagaggaagcaatgcaaaaccggatccagatcgacccagtcaaattgagctcgggatacaaggacgttatcctgtggttctcatttggcgcctcctgtttcatattgttggctattgtgatgggtctggtgttcatctgtgtcaagaatgggaacatgaggtgcaccatttgtata

SEQ ID NO: 602 - DNA, 1680 bp, Influenza A virus
  misc_feature (1)..(1680): Codon Optimized Sequence Encoding H7 Hemagglutinin
atgaacacacagattctcgtgtttgcgctaattgcaatcatacccactaatgcagacaaaatctgtctgggacaccacgcggttagcaatggcacgaaggtgaataccctgacagagagaggagtggaggttgttaacgcgaccgaaactgttgaaaggactaatatccctcgtatctgttcaaagggaaaaaagaccgtagacctgggccagtgtggactgctcggcacgatcacagggccacctcagtgtgaccaatttctggagttcagtgctgacctgattatcgaaagaagagagggatcagacgtatgttatcccggaaagttcgtgaatgaggaagcccttcgacagatcttaagagaatcaggcgggatcgataaggaagcaatgggcttcacctactctggcattcggaccaatggcgcaacttctgcatgccgcagatccggctctagtttttacgcggagatgaagtggctcctctccaatacagacaatgcagcattcccacaaatgaccaagtcttataaaaacacccgcaagtcccccgctctcatcgtttggggtatccaccatagtgtgtccacagccgagcaaacaaagctatacggaagtggcaacaagctggtcacagtgggcagtagtaattatcagcagagcttcgtgcctagccccggggccaggccacaggttaacggccagtcagggcgcatcgactttcactggcttatgctgaacccgaacgacactgtcacattctcattcaacggcgccttcatagcacccgatagggcctcatttttaagggggaagtctatgggaattcagtccggagtgcaggtcgacgccaactgtgagggcgactgctaccatagtggaggaaccatcataagtaatctgccatttcaaaacatcgattcacgcgcggtgggaaaatgccccaggtatgtcaagcagcggagccttttgcttgctaccgggatgaagaatgtgcccgagattcccaaggggagaggtttattcggggctatagccgggtttattgaaaacggttgggaggggctaatagacggatggtacggcttcaggcaccagaatgctcaaggggaagggactgccgctgattataagagcacgcagtcagctatcgaccagatcactgggaaattgaatcgtttaatcgagaaaaccaatcagcagttcgaactgattgataacgagttcaacgaggtcgagaaacaaataggaaacgttataaactggacacgagattccataaccgaggtgtggtcctataatgctgaactactcgtagccatggagaaccagcataccattgatctggccgactctgagatggacaagctatatgaacgggtgaaaagacagttgcgcgaaaacgcggaagaagacgggacaggttgctttgaaatttttcacaaatgcgatgacgactgcatggctagtatacggaacaacacatacgatcactctaagtatcgcgaggaggcaatgcagaatcgcatccagatcgatcccgtcaaactgtcttccggatataaagatgtcatactgtggttctctttcggcgcaagctgtttcattctcctagccatcgtcatgggtctggttttcatatgtgtgaagaacgggaacatgcggtgcaccatatgtata

SEQ ID NO: 603 - DNA, 1680 bp, Influenza A virus
  misc_feature (1)..(1680): Codon Optimized Sequence Encoding H7 Hemagglutinin
atgaatacgcagatcctggtgtttgctttaatagccatcatccctactaacgcagacaaaatttgtctcgggcaccacgccgtgtctaatggaacaaaggtcaacactctgacagaacgcggagttgaagtagtgaatgccactgaaactgtggagaggaccaatatccctcgcatttgttctaagggaaagaagaccgtcgacctcggtcagtgcggcctattgggaaccatcactggccctcctcagtgtgaccagtttctggagtttagtgccgatttgatcatcgaaagaagagagggaagcgacgtttgttatcccggaaagtttgtcaacgaggaggctctccgccaaattctcagggaatctggaggtatcgacaaggaagcaatgggcttcacttattcaggcattcgcacaaacggggccacctctgcatgccgccgcagcggctctagcttttacgccgaaatgaaatggctgctctccaatactgacaacgctgcctttccccaaatgaccaagtcctataaaaacacgcgcaaaagtccggccctcattgtgtgggggattcaccactccgtctccacagccgagcagactaagctgtacggtagtggtaataagttggtcaccgtggggtcaagtaattatcagcaaagcttcgtccctagccccggggccagaccccaggtgaacggacaaagcggaaggatcgattttcactggctgatgcttaaccctaatgacaccgttacattcagttttaatggtgcgtttatcgcccccgatcgggcctcctttcttagaggcaaaagtatgggtatccagagtggagtacaggtcgatgccaattgcgaaggcgactgctatcactctgggggaacaattatctccaatttaccgttccagaacatcgactctagggcagtcggcaaatgccctagatatgtaaagcagaggtctctgctgctcgccacgggaatgaaaaacgtcccagagatcccaaaaggcagaggactgttcggagccatagctggctttatcgagaacggctgggagggactgatcgatggatggtatggtttccggcaccagaatgcacaaggtgagggaactgccgcagattataagtccacccaaagtgccatcgatcagattacaggcaagttaaacagacttattgaaaaaacaaatcaacagtttgagcttattgacaacgagttcaatgaagttgagaagcaaatcggtaacgttatcaattggactcgcgactccatcaccgaggtgtggtcttacaacgcggaactacttgtagcgatggaaaatcagcataccatcgacttggccgactcggagatggataagttgtacgagagagtgaaacggcagctcagggaaaacgcggaggaggacggaacaggttgtttcgaaatatttcacaagtgcgatgatgactgtatggctagcattcggaacaacacttacgatcactccaagtaccgtgaagaggctatgcagaacaggattcagatcgatccggtgaaactctcaagcggatacaaggacgttatactttggttcagcttcggagcttcttgctttattcttttggctatcgttatgggactagtgtttatatgtgtgaaaaacggcaacatgcgctgtacgatatgcata

SEQ ID NO: 604 - DNA, 1680 bp, Influenza A virus
  misc_feature (1)..(1680): Codon Optimized Sequence Encoding H7 Hemagglutinin
atgaacacacagatccttgtgtttgcactgattgccatcattcccaccaatgccgacaaaatctgcttaggtcaccacgctgttagcaacggaacgaaggtcaacaccctgaccgaacgaggcgtcgaagtagttaatgctaccgaaactgtggagaggaccaacatacccaggatctgcagtaagggtaagaagacagtcgatctaggccagtgcggactactcggcacaattaccggacctccccagtgcgaccagtttcttgagttcagtgctgatcttattatagaacgacgagaagggagtgatgtgtgctatcccggcaagtttgtgaacgaagaggcgctgcgacaaatcttgagggagtcaggcgggattgacaaggaagcaatggggtttacatattcaggtattcgtactaatggagcaacatctgcctgccggcgcagtggctccagcttttacgcggaaatgaaatggctgttaagtaacaccgacaatgcagcatttccccaaatgacaaagagttataagaatacacgaaagtcacccgcactgattgtatggggcatccaccattcggtgtcgaccgctgaacagacaaaattgtacggctcaggcaacaaactggtgactgttggttcttctaactaccagcagagctttgtcccgtcacccggagcccgaccacaggtgaatggacagtccggacggattgactttcactggcttatgctcaatcccaatgatactgtgacatttagtttcaacggggcctttatagctcccgatcgggcttcttttcttcgaggaaaatcaatgggcattcaatccggagttcaggtggacgccaattgtgaaggagactgttaccattccggaggtacaattatttccaacctgcctttccaaaatatcgatagtcgagccgtgggaaagtgtcccagatatgtaaaacagagaagtctattgctggctacagggatgaaaaatgtgcccgaaatacccaagggacggggattgtttggtgccatagctgggtttatcgagaatgggtgggaaggccttatcgacggctggtatggctttcggcaccaaaacgcgcagggtgaggggaccgcggcagactacaagtctactcagagcgcaattgatcagattaccggcaaactgaaccgactaatagaaaaaacaaaccagcagtttgagctcattgataatgaattcaacgaagtggagaagcagattgggaacgtgatcaattggacgcgcgattccatcactgaggtgtggagttacaatgccgaactcctggtggccatggaaaaccagcacacaattgacctcgctgactctgagatggacaagttgtatgagcgcgtgaagcggcagcttagagagaacgccgaggaagacgggacagggtgttttgagatcttccataagtgcgatgacgactgcatggcatccatccgtaacaacacatatgatcactcaaagtatagggaggaagccatgcagaacaggattcagatcgaccctgtgaaactctcatcagggtacaaagatgtaatcttgtggttttcgtttggagcttcgtgcttcattctgctagcgattgtcatgggccttgtgtttatctgcgtcaagaacggcaacatgaggtgtactatctgtata

SEQ ID NO: 605 - DNA, 1680 bp, Influenza A virus
  misc_feature (1)..(1680): Codon Optimized Sequence Encoding H7 Hemagglutinin
atgaatacccagattctggtgtttgcgctgattgccataatccccactaacgctgataagatctgcctggggcaccatgcagtgtctaatggcactaaggtcaatacgctcacggagagaggcgtggaagtggttaatgctaccgaaactgtggaacggactaacattccaagaatctgttcaaagggtaagaaaactgtggacctcggccaatgtggcttgctgggcaccatcactgggccaccacagtgtgatcagtttctcgagttctctgccgatttaatcatcgagcgccgggaaggatcagatgtgtgctacccgggtaaattcgtgaatgaggaagcactgagacagattctgcgtgaatcaggagggattgataaggaggctatggggtttacatactctggcatcagaacaaatggggccaccagcgcgtgccggcgctctgggagttctttctacgctgaaatgaaatggctgctttctaacacggacaatgccgctttcccccagatgacaaaaagctacaagaacactcgcaagagccctgcactcatagtgtggggcatccaccactccgtctctactgcagagcagaccaagctgtacggcagcgggaacaagcttgtaaccgttggatcttcaaactaccaacaatcattcgttccctctcctggagcccggccccaagttaatgggcagtccgggagaatcgacttccattggctgatgctaaatcccaatgatacagttacctttagctttaacggcgccttcatcgctccggatagagcgagcttccttcgcggtaagtctatgggaatccagtccggggtgcaagtcgacgcaaactgcgagggagactgttaccattccgggggtactatcatttcaaatttaccctttcagaacattgatagccgcgccgtaggcaaatgtcctaggtatgtgaaacagagaagcctgctcctggcaaccggaatgaagaacgtgcctgagatccctaagggtagaggacttttcggagctatcgccgggttcatcgagaacggttgggagggactcattgatgggtggtatggtttccgccaccagaacgcccaaggggaaggcactgctgctgactataaatcaacgcagtccgccatagaccagattacaggtaaattaaatagactgattgagaaaacaaaccagcaattcgagctaatcgacaatgagtttaatgaggtcgagaagcagatcggtaacgtcataaattggacacgggatagtatcaccgaagtgtggagctacaatgctgagctcctagttgccatggagaatcaacatacgatcgacctggcggattctgaaatggacaagttatacgaaagagtgaagcgacagctaagagagaatgcagaggaagacggcactggctgcttcgaaatatttcacaagtgtgatgatgactgtatggcaagcatcaggaataacacctacgaccacagtaagtatagagaggaggcaatgcagaacaggatacagatcgatcccgtcaaactttccagtggctataaggacgttatcctttggttctcgtttggggcgagctgcttcatcttgctggcgatcgtgatgggcctcgtgtttatttgcgtgaaaaacggaaacatgaggtgtacaatttgtatt

SEQ ID NO: 606 - DNA, 1680 bp, Influenza A virus
  misc_feature (1)..(1680): Codon Optimized Sequence Encoding H7 Hemagglutinin
atgaatacacaaattctggtcttcgcactgatcgccataatccccactaacgcagacaagatctgtctcggtcaccacgccgtttcgaatggtactaaggtaaatacgctgacagagaggggggtggaagtcgtgaacgccactgagaccgtcgaaaggacaaacattccccgcatctgttcgaagggaaagaagaccgtcgatcttgggcagtgcggtctcttgggtacgatcacagggcctcctcagtgcgatcaattcctggagttttcagccgacctgataatcgaaagaagggagggaagcgatgtgtgttaccccgggaagttcgtgaatgaggaagccctgcgacagatcctaagggagagcgggggaatcgataaagaggcaatggggttcacctatagtggaatcagaactaacggcgccacttccgcctgccggagatcgggtagctctttctatgctgaaatgaaatggctgctcagtaatacagacaacgcggcgttcccacagatgaccaagtcctataagaatacccggaaatctcctgcgcttattgtgtggggcatccaccactctgtgtccaccgctgagcagacaaaactttacggatcaggaaataagctcgtcaccgtgggaagctccaattatcagcaatccttcgtgccatcccccggagcaagaccacaggtgaatggacagtccgggaggatcgatttccactggttgatgctgaaccccaatgatactgtcacgttcagcttcaacggtgcttttattgctcccgatagggccagctttctgagaggcaagtccatgggcatccagagcggggtccaagtggacgctaattgcgagggtgattgctaccactctggaggcaccatcatcagcaacctgcctttccagaatatagattcccgggcggtggggaagtgcccaagatacgtcaagcaacggagcctcctccttgcgactggaatgaaaaacgtgccagagattccaaaggggaggggcctgtttggagcgattgccggattcatcgagaatggctgggaagggctcattgacggatggtatggctttcgccatcagaacgcccagggagaggggaccgcggccgactacaagtccacccaaagcgccattgaccaaatcacaggaaagctgaatcgcctaatcgaaaagactaatcagcagttcgagctgatagataatgagttcaacgaggtcgagaaacaaatcggaaatgtcatcaattggacccgcgactctataacagaagtttggtcctataacgcggagctgctagtcgccatggaaaaccagcacactattgaccttgccgatagcgaaatggacaagctgtatgaaagggtgaaaagacagctgcgcgagaatgcagaagaggacggtaccggctgtttcgagattttccataagtgtgacgacgactgcatggcatcgattcgaaacaacacatacgaccactctaagtatagagaggaggccatgcagaacagaatccagatcgatcctgtgaagctgtcatccgggtacaaggatgtcattctttggttctcattcggtgcgtcttgtttcatcctgctcgccatagtcatggggctggtcttcatttgcgtgaaaaacgggaacatgcggtgtacaatttgcatc

SEQ ID NO: 607 - DNA, 1680 bp, Influenza A virus
  misc_feature (1)..(1680): Codon Optimized Sequence Encoding H7 Hemagglutinin
atgaatacccagatactcgtgtttgcccttatcgctataatccccacgaatgcagacaaaatctgccttgggcatcacgccgtgagtaatggcaccaaagtgaacacattgaccgagcggggggtggaggtagtcaatgccaccgaaacagtggaacgcaccaacattcctcggatctgtagcaaaggaaagaaaacagtcgatctgggccagtgtggcctgttaggaaccatcactggaccgcctcaatgcgatcagtttctcgaattcagcgcggatctcattattgaaagaagagagggttctgacgtgtgttaccccggcaagtttgtgaacgaagaagcactccgccagatacttagggagtccggcgggatcgacaaagaggctatggggtttacttatagtggaatccgcacgaacggggccacgtccgcctgcagacggagcggctcctcattttacgcggagatgaagtggctgctcagcaacacagacaatgccgcctttccccagatgacaaagtcttacaagaacaccagaaagtcgccagccctcatagtctgggggatacatcacagcgtttccaccgccgagcagactaagctgtatggcagcggaaataaactggtgactgtgggctccagcaattaccagcaaagctttgtacccagccccggagcaaggccccaagtgaatggccagtctggtagaatcgatttccattggcttatgttgaaccctaacgacacggttacattcagtttcaatggggcatttatcgcccccgaccgtgcctctttcttgaggggtaaatctatgggcatccagtcaggtgtgcaggtggatgctaattgcgaaggcgactgctatcacagtggcggtactatcatatccaatctgccttttcaaaacatcgattcccgtgcggtggggaagtgtcctcgatacgtgaaacagcgctcattgctgttggccaccggaatgaaaaacgtgccagagatcccaaagggcagaggtctgttcggagctattgctggctttatcgaaaacggctgggaagggctgattgacggctggtatggatttaggcaccaaaatgctcaaggcgagggcacagccgccgactataaaagcactcaaagtgcgatagaccagatcacaggcaagctgaaccgcctgattgagaaaacaaaccagcagttcgaactcattgacaacgaattcaacgaagtggagaaacagatcggaaatgttatcaattggacaagagacagtattacagaggtgtggtcctataacgccgagctcctggtcgctatggagaatcagcataccatcgacctggcggattcagagatggacaaactttatgagagagttaaaagacaactgcgtgagaatgctgaagaagatggaactggatgcttcgaaatttttcataagtgtgatgatgactgtatggcgtcaatccggaataacacctacgatcactccaaatatagagaagaggcaatgcagaatcgtattcagatagaccctgtgaaattgtccagtggatacaaggacgtaattttgtggttcagcttcggggcttcctgtttcatcctcctcgccatcgtgatgggtctcgttttcatatgcgtgaagaacgggaatatgaggtgcacgatatgtatc

SEQ ID NO: 608 - DNA, 1680 bp, Influenza A virus
  misc_feature (1)..(1680): Codon Optimized Sequence Encoding H7 Hemagglutinin
atgaacacccagattctggtgttcgctctcatcgcaatcatacccaccaatgctgacaaaatctgtttggggcatcatgccgtcagcaacggcactaaggtcaatactcttacagaacgcggggttgaggttgtcaatgcaactgaaaccgtggaaagaacgaatatcccacgtatttgcagtaagggcaagaaaaccgtggacctcgggcaatgcgggctgcttggaacgattaccggcccaccccaatgcgatcagttcctcgagttttctgcagatttgattattgagcgaagggagggctccgacgtctgttatcctggaaagtttgtgaatgaggaggcactgcgccagatactccgtgaaagcggcgggattgataaggaggccatgggctttacttactcgggaatacgcacaaatggagccactagcgcctgccggaggtctggatcaagcttctacgcagaaatgaagtggttactaagcaacacagataacgcagctttcccacagatgacaaaaagctataagaatactcgcaagtcccctgccctgatagtatggggcatccaccactctgtctctaccgccgaacagactaagctgtatggaagcgggaataaactggttacagtgggaagcagtaactatcagcagagttttgtcccatccccaggcgctaggccacaagtcaacggacagagcgggagaatagattttcattggctcatgttaaatcctaacgacacagtgactttctcgtttaatggcgcttttatcgcccctgatagggcctcttttttaagaggcaagagcatgggaatccagtctggagtgcaggtcgatgctaattgcgaaggcgactgctaccacagcggaggaacaatcatctctaatttgcccttccagaatattgatagtcgcgcagtgggcaaatgcccccggtacgtaaagcagcgctcactcctgctggcaacagggatgaaaaatgtccctgagatcccaaagggcagaggactgtttggtgccattgccggattcatcgagaacggatgggaggggctgatcgacggatggtatggattccggcatcagaacgcccagggcgaagggacagccgctgattataagtccacccaatcagccattgatcagattaccggcaaactaaatcgcttgattgagaaaacaaatcagcaattcgaattgattgacaatgagtttaatgaggttgagaaacagatcggaaacgtgattaattggacacgggattctataaccgaggtctggtcatacaatgctgaacttctggtcgcgatggagaaccagcacacaattgacctggccgatagtgaaatggataagttatacgaacgggtcaaacggcagctgagggagaacgccgaagaagacggtaccggttgtttcgaaatcttccataagtgtgatgacgactgcatggcctcaattcggaacaacacctacgatcacagcaagtatagagaagaggctatgcaaaaccgcatacagatcgacccagtaaaattaagtagtggctacaaagatgtgattctttggttctcctttggagccagctgctttattctgctggcaatagttatgggcctcgtctttatctgtgtcaagaatggaaacatgaggtgtactatttgcata

SEQ ID NO: 609 - DNA, 1680 bp, Influenza A virus
  misc_feature (1)..(1680): Codon Optimized Sequence Encoding H7 Hemagglutinin
atgaacacgcagatccttgtatttgcgctcatagcaataatccctacgaatgcagataagatttgcctgggacaccatgctgtctctaacggaaccaaggtcaatacactgactgaacgtggcgttgaggtggtgaatgcaactgagaccgttgagcgaaccaacatcccccgcatttgctctaagggaaagaagacagtcgatctcggacagtgtggcctgctcggcacaattacggggccccctcagtgcgatcagttcttggaattctctgccgacctcatcatcgagcgccgggaaggctctgacgtttgttatcctggcaaattcgtgaacgaggaggcattgaggcaaatcttgagagaatctggaggtatagataaggaagccatgggctttacgtactctgggattaggaccaatggtgcaacttctgcgtgccgtaggagcggaagttctttctacgctgagatgaaatggctgctgtcgaatactgataatgccgcttttccccagatgaccaagtcttacaagaataccaggaagtctcctgccctgattgtgtggggtatccaccacagcgtgtccacagccgaacaaaccaaactttatggctcaggtaataagctcgtcactgtcggtagctctaattatcagcagtcttttgtccctagccccggggctaggccacaggtcaacggccagagcggacggattgacttccactggctgatgctgaacccgaacgacacagtaacgtttagcttcaatggcgcctttattgccccggaccgagcttcattcctgcggggtaagagtatggggatccaatcaggtgttcaggtggacgccaattgcgaaggcgattgctatcattccgggggtaccattatctccaacctcccatttcaaaatattgatagcagggccgtgggcaaatgtcccaggtatgttaagcagcgttctctgttactggccactggcatgaagaatgtccctgaaatcccaaagggcagaggactgttcggcgcgatcgcgggatttatcgaaaacggatgggagggcttgatcgatggctggtatgggtttcgacatcagaacgcccaaggggagggaaccgccgctgattataaaagcacccagagtgccattgatcagatcacgggcaaactgaaccggctcattgagaaaacaaaccagcagttcgaactcatcgataacgagtttaatgaggtggagaaacaaatcggcaacgttattaactggactagggattctatcacggaggtctggtcctacaacgcagaactgctggtggcaatggaaaatcaacatactattgatctggccgattccgaaatggacaagctttacgagagggtcaagagacagctgagagagaacgctgaagaggatgggaccggatgcttcgaaatctttcataagtgtgatgatgattgcatggccagtatccgtaataatacatatgatcattctaaataccgcgaagaggcgatgcagaatcgaatccaaattgacccagttaaactgtctagtggctacaaagacgtcatcctgtggttttcgttcggagcttcttgcttcattctgttggcaatagtgatgggcctcgtatttatatgtgtgaaaaacgggaatatgagatgcacaatttgtatt

SEQ ID NO: 610 - DNA, 1680 bp, Influenza A virus
  misc_feature (1)..(1680): Codon Optimized Sequence Encoding H7 Hemagglutinin
atgaatacccagatcctggtgttcgcccttattgccatcattccgaccaacgctgacaaaatctgtctcggacaccacgctgtctccaatgggacaaaggtgaataccttgaccgagcgaggggtcgaggtcgtcaacgcgacagaaacagtggagaggaccaacattccccggatatgctcaaagggcaaaagaacggtggatctggggcaatgcgggctgctgggcactataaccggacccccccaatgtgaccagtttcttgaattttctgccgatctgataatcgaacgccgggaaggatccgacgtgtgctatcctggaaagtttgtgaatgaggaagccctccggcagattctgagggaatccggagggatagataaggaagcaatggggttcacttatagcggtatccgcacaaatggggcgactagtgcatgtcgtcgaagtggaagcagtttctatgccgagatgaaatggctgctaagcaatacagacaacgccgcattcccacagatgaccaagtcctataaaaatacaagaaagagtcccgcgcttatcgtgtggggcatacatcactccgtcagcaccgccgaacagaccaagctctatggctcaggcaacaagttggtgacagtcggcagtagcaattaccagcagtccttcgtgcctagcccaggcgaaaggcctcaggtgaatggtttgagcggccgaatagacttccattggttaatgctcaatcctaacgatacagtcacgttcagtttcaatggtgcctttatagcgcctgatcgcgcatcattcctgcgtggaaaatctatgggcattcagagcggagtccaggtcgacgccaactgcgaaggcgactgttatcactccgggggcaccattatttccaatttgcccttccagaacattgatagcagagcagttggcaagtgcccgcgctacgtaaaacaaaggtctctgcttttggctacaggtatgaaaaatgtcccagaaattcccaagggccgcggattgttcggggcgatcgctggttttattgagaacggttgggaaggcctcatcgatgggtggtatggttttcggcatcagaacgcccagggcgaaggcactgccgcggattataagtccacccagtcagcgatcgatcagatcacaggaaagctgaaccgacttatcgaaaaaacaaaccagcagtttgaactaattgacaatgaattcaacgaggtggagaaacagattggcaatgtgattaactggacccgtgatagcatcacagaggtctggagctataatgcagaactgttggttgctatggagaatcagcacaccatcgacctggccgactctgaaatggacaaactgtacgagcgagtgaaacggcagctgcgtgagaacgctgaggaagacggcaccggttgtttcgaaatcttccataaatgcgacgacgactgtatggcttctattagaaacaatacctacgatcactccaagtaccgggaggaagcaatgcagaatcgaatccagatcgacccagttaagttgtccagcggatacaaggacgtgattctatggtttagttttggagcctcctgcttcattcttctggccattgtgatgggtttggtttttatctgtgtaaaaaatggaaatatgcgctgtactatttgtatt

SEQ ID NO: 611 - DNA, 1680 bp, Influenza A virus
  misc_feature (1)..(1680): Codon Optimized Sequence Encoding H7 Hemagglutinin
atgaacactcagattcttgtgttcgctctgatcgcaattatacccacaaacgcggataaaatctgccttggacatcacgcagtgtcgaacggaactaaggtgaacactctcaccgagcggggcgtcgaagtagtcaatgctacagagaccgtcgaacgcactaatattccacgtatctgctccaaggggaaaaggaccgtcgacctgggacaatgtggcttgctagggactattaccggcccaccgcagtgtgatcaattcctcgagttctcagccgacctgatcatcgagcgacgcgagggcagcgatgtctgttaccccgggaaatttgttaatgaggaagcattaaggcagatcctgcgcgagtctggcgggatcgacaaggaggccatgggctttacatattccgggatccggacaaacggcgccacaagtgcctgtcgacggtcaggatcatcattctatgccgagatgaaatggcttctcagcaataccgataacgctgcatttccacagatgacaaagtcgtataaaaacacaagaaagtcacccgctctgattgtttggggaattcaccacagtgtctcaaccgcagaacagaccaagttgtacgggagtggaaacaagttggtaaccgtgggatcttcaaactatcagcagagcttcgtgccaagccccggggaacgcccccaagtgaatggactgtctggacggattgacttccactggctgatgctgaaccccaacgacacagtgacattcagttttaatggagcatttatcgccccggacagagcaagctttctcaggggtaagagtatgggaattcagagtggtgtacaggttgacgctaactgcgaaggtgactgttatcattctggtgggactatcatctccaacctgcctttccagaacattgactccagagcagtcggcaagtgccccaggtacgtgaagcaaaggtctttgctgctcgcaaccggcatgaagaacgtgcctgaaatacctaagggccgtggcttgtttggcgcaatcgcgggatttatcgaaaatgggtgggaggggttgattgacggttggtacggcttccgtcatcagaatgcccaaggggagggcaccgccgcagactataaaagcacccaaagtgcaatcgatcagatcaccggcaaattgaaccggctgattgagaaaacgaatcagcagttcgaactgatcgacaacgaatttaacgaggtcgaaaagcagattggaaatgtgatcaactggacccgggattccatcaccgaagtctggtcatataacgcggaactgcttgtagcaatggagaatcaacacactatcgatctggcggacagtgagatggataagctctacgagagggttaagagacaactgcgcgagaatgctgaggaagatggtaccgggtgtttcgagatttttcacaaatgtgatgatgactgcatggctagtattcgcaacaacacatatgatcactccaaataccgcgaagaggctatgcagaaccgcatccaaatagatcccgtaaagcttagctcgggttacaaagatgtaatcttatggtttagtttcggagcgagctgttttattctactcgccattgtgatggggcttgtcttcatatgtgtgaagaatggaaatatgcgctgcacaatctgtata

SEQ ID NO: 612 - DNA, 1680 bp, Influenza A virus
  misc_feature (1)..(1680): Codon Optimized Sequence Encoding H7 Hemagglutinin
atgaatacccagattcttgtcttcgcactcatagctattattcctacgaacgcggacaagatttgtctggggcatcacgccgtctccaatgggacaaaagtgaacaccctgactgaacgaggggttgaagtggtcaatgcaactgaaacagtggaacggacaaacattccaagaatctgttccaaaggaaagcgaacagtggacctgggacagtgcggcctgctgggtaccattactggccccccacagtgcgaccagttcctggaatttagcgcagatcttatcatcgagcggcgggaaggaagtgacgtgtgttatcccgggaagtttgtaaacgaggaggccctccggcagatccttcgtgagagcggcgggattgataaagaggctatgggctttacctattccggaataagaaccaacggggccacttctgcgtgtcgtaggagcggcagcagcttctacgccgaaatgaagtggctgttgtctaacaccgataatgccgccttccctcagatgaccaagtcctataagaacacccggaaatcccctgccctgattgtttgggggattcaccattccgtatctaccgccgaacagaccaagttgtacggttccggaaacaagctcgtcacagttggctcctccaattaccagcagagtttcgtaccttctcccggcgcaagaccacaggtcaacggactaagcgggcggattgactttcactggctcatgttgaatccaaatgacactgtaacctttagtttcaacggtgcctttatagcaccagatcgggccagctttctgcgtggaaagtctatgggcattcaaagtggtgtgcaagtggatgctaactgtgagggagattgctaccattcaggtgggacaatcattagcaatcttccgtttcagaatattgattcacgggctgtgggcaagtgcccccgttacgtgaagcagagaagcctgcttcttgccacgggaatgaagaatgttcccgaaataccaaagggtaggggtctcttcggagcaatagccggatttatcgagaatggctgggaggggcttatcgatggttggtacggctttcgccatcagaacgctcagggagaggggaccgcagcagactacaaatccacccagtctgctatcgaccagatcactggcaagctgaatcggataatcgagaagactaaccagcagtttgagctgatcgacaatgagtttaacgaagtggagaaacagattggcaatgtgatcaattggacaagagattccattacggaagtttggtcatataatgccgagctcctggttgcaatggagaaccaacatacaatcgacctggcggacagtgagatggacaagctgtacgagcgtgtgaagcgccaactccgggaaaatgctgaggaagacggcacgggctgctttgaaatcttccacaagtgtgacgacgactgcatggcaagcataaggaacaacacctatgatcattctaagtacagagaggaggcgatgcagaatcgcatccagattgacccagttaagctttccagcgggtacaaagacgtcatcttgtggttttcctttggtgcctcttgtttcattttgctcgctatcgtaatgggactggtattcatctgcgtgaaaaatggaaatatgagatgcaccatctgcatt

SEQ ID NO: 613 - DNA, 1680 bp, Influenza A virus
  misc_feature (1)..(1680): Codon Optimized Sequence Encoding H7 Hemagglutinin
atgaacacacaaattctggtgttcgctctcatcgcaataattcctaccaacgccgataagatttgcctggggcaccatgcggtcagtaacggaaccaaagtcaatacactcacagaaagaggcgttgaggtggtgaatgccacagaaactgttgaacgtacaaatattccgcgaatctgttctaaaggcaagaaaaccgttgatctgggtcaatgcggccttctgggaaccattacagggccacctcagtgcgaccagtttctcgaattttctgctgatctcattatcgagaggcgggaaggcagtgacgtttgctaccctggtaagttcgtaaatgaggaggccctcaggcagatcctgaggaagtccggcggtattgataaggaagccatgggcttcacttattctgggatcaggaccaacggggccacttcaacatgtagaaggtccggaagctctttctatgcagagatgaaatggctcctgagcaacacagacaacgccgcctttccacagatgaccaagagctataagaatactcgcaaatctccagccatcatagtgtggggtatccaccacagcgtgtccacggccgagcagacaaagctgtatgggagcggcaacaagctggtgactgtcggtagctcgaattaccagcagtctttcgtgcctagccccggggcccggccgcaggtcaatgggctttccgggcgaatcgactttcactggttgatgttaaacccaaacgacacggtgacattcagctttaacggcgcctttattgcacctgaccgcgcatgtttcctgaggggcaagtctatgggtatccagtctggtgtacaagtcgacgccgactgtgaaggagactgctaccattccggcgggacaataatctcaaacctacccttccagaacatcgacagtagggcggtgggcaagtgtcctaggtacgtgaaacagcggagcctgctgttggccacaggcatgaagaatgtccccgaaattccaaaggggcggggtctctttggagcaattgcaggattcattgagaatggttgggaaggtctcatcgatggatggtacgggttccgccatcagaacgcccagggtgaggggaccgcagccgactataagagtacccagtcagcgatcgaccaaatcaccggcaagctaaatcggctgattgagaagacaaaccaacagtttgaattaattgacaacgagtttaatgaggtggaaagacagatcggcaacgtgatcaactggacacgcgattccatcacagaagtctggtcttataatgcagagctgctagtggccatggagaatcagcacaccattgatctagccgactctgaaatggacaagttgtatgaacgggtaaaacgtcagttacgagaaaatgccgaggaagatggcacagggtgtttcgagatttttcacaaatgtgacgacgattgtatggcaagtattcgtaacaacacatacgaccacagcaaatacagagaggaggccatgcagaaccgcatccagatagacccagttaaactgagctccgggtacaaggatgtgatcctctggtttagtttcggcgcaagttgtttcatcctactcgcgatagttatgggcctggtattcatttgcgtcaagaacgggaacatgaggtgtaccatctgcatt

SEQ ID NO: 614 - DNA, 1680 bp, Influenza A virus
  misc_feature (1)..(1680): Codon Optimized Sequence Encoding H7 Hemagglutinin
atgaatacccagattctcgtgtttgctttgattgctatcatccccacgaatgctgataaaatttgcctaggccatcatgctgtgtctaacgggaccaaggtgaacaccctcactgagagaggcgtggaggtcgtgaacgcgaccgagactgttgagcgcacaaacattcccaggatttgtagcaaaggaaaaagaaccgttgatctcggccaatgcggcctcctgggtaccatcacggggcctccacagtgtgaccagttcttggaattcagtgcagaccttatcatcgagcgcagggagggctctgatgtatgctaccctggaaaattcgtgaacgaggaggctttgagacaaatcctgagggagtctggaggcatcgataaggaggccatgggctttacatacagcggcattcgcactaacggagccacttccgcatgcaggcggtccggcagctcattctacgctgaaatgaagtggctcctgagtaatacggataacgccgcctttccgcagatgaccaaaagttataagaatacaaggaaatcacctgctctcattgtctggggtatccaccactcggtgagcaccgctgagcagaccaaactgtacgggtcaggcaataaacttgtgaccgtgggctcaagcaattaccagcagtcctttgtgccttcacccggcgaaagacctcaagtcaacggactgtctggtcggatcgactttcactggctgatgttaaacccaaatgatacagtgacattctccttcaacggagcattcatagcccccgatagggccagcttcctccgggggaaatccatgggaattcagtcaggcgtccaggttgacgctaactgcgagggtgactgttatcattccggaggtactataataagcaatcttccattccagaatatagattcacgagcggtcggcaagtgtccgcggtacgttaaacagcgtagcttactgctcgcaaccgggatgaaaaacgttccagaaattcctaagggcagagggctgtttggggccatcgccggcttcatcgagaacggttgggaagggctcatcgatggctggtacggttttagacaccagaatgcccagggcgaggggaccgcagcagattacaagagcacacagtcagccatagatcaaattactgggaagctcaatcggttgatagaaaagactaaccagcagttcgaattgatcgataatgaatttaacgaggtcgagaaacaaatcggcaatgttattaattggactagagactccatcacagaagtgtggtcctacaatgccgaactgctggtggctatggagaaccagcacacaatcgaccttgcagacagtgagatggataaactgtatgagagagtgaaaaggcagctccgcgagaacgctgaggaagatggaaccggctgttttgaaattttccataagtgcgacgatgattgcatggcttctatccggaataatacttacgaccacagtaagtaccgagaagaagccatgcagaatcgaattcagatagaccccgtcaagctgagctccggctataaagatgtgattctgtggttcagctttggggcctcttgtttcattcttttggccatcgtgatgggccttgtgttcatttgtgtaaaaaatggcaatatgaggtgcacaatatgtatt

SEQ ID NO: 615 - DNA, 1680 bp, Influenza A virus
  misc_feature (1)..(1680): Codon Optimized Sequence Encoding H7 Hemagglutinin
atgaatacccagatactggtgttcgccctgattgcaatcatcccaactaacgctgataagatttgtctcggtcaccacgctgtgagtaacggaactaaagttaacacactgacagagaggggagtggaggttgttaacgcgacagagacagtggagcgcactaatataccacggatatgtagtaagggaaaaagaactgtggacttgggtcaatgcggactgttggggacgataactggcccccctcagtgtgatcagtttctggagttctcagccgatctgatcatcgagaggcgagaggggagtgatgtgtgttatcctggtaagtttgtgaatgaggaggctctcaggcaaatcctcagggaatctggagggatcgataaggaggctatgggcttcacttactctggaataagaactaacggcgccactagcgcctgtaggcgatccggaagttcgttctacgctgaaatgaagtggttgctcagcaacactgacaacgcagcatttccccaaatgaccaaaagctataagaatactcgcaagtctcccgccctgatagtgtgggggattcaccatagtgtctctacagccgagcagactaaattatacggcagtggcaacaagctggtgacggtggggagttcaaattaccagcagagcttcgtgcccagtccgggagctcgccctcaagttaatggtctttccggcagaattgattttcactggctgatgcttaaccctaacgacaccgtgaccttttccttcaacggcgctttcattgccccggaccgagctagtttccttagggggaagtctatgggcatacagtctggtgtgcaagttgatgcgaattgcgagggggattgttaccactctggaggtacaatcatcagtaatttacccttccagaacattgatagtagagccgttgggaagtgtccacggtatgttaaacagcgcagcctgcttctggccacagggatgaagaatgtccccgaaatccccaaaggcagaggattgttcggcgcaatcgcggggtttattgaaaacggttgggaaggcctcattgacggctggtacgggttccggcaccagaatgctcaaggagagggcaccgccgccgattataagtctacccagagcgccatcgaccagatcacaggcaaattgaaccgaattatcgagaagaccaaccaacagttcgagcttatcgacaacgaatttaatgaagtagaaaagcagatcggaaacgttattaactggactcgggacagtattactgaagtgtggtcctataatgctgagctgttggtggcaatggagaaccagcacaccattgacctggccgacagcgagatggacaagctttacgaaagagtgaagcgacagcttcgggaaaacgccgaggaagatggaaccggctgttttgaaatcttccataagtgcgatgatgactgtatggccagtatacgcaacaacacttatgaccattcaaaataccgcgaagaagccatgcagaatcggatccagatcgaccctgtgaagctgtcgagcgggtataaggacgtgatactgtggttcagcttcggagccagctgcttcattctgctggctattgtcatgggcctggtgttcatttgcgtcaaaaatggtaatatgaggtgtacgatctgcatc

SEQ ID NO: 616 - DNA, 1680 bp, Influenza A virus
  misc_feature (1)..(1680): Codon Optimized Sequence Encoding H7 Hemagglutinin
atgaacactcagatcctcgtgtttgccttgatcgcaataatccccaccaatgccgataagatatgtctcggacaccacgctgtgtccaacgggaccaaggttaatactctgacagagcggggcgttgaagtggtgaatgccaccgaaaccgtggaacggacaaatattccacgaatttgcagcaagggaaagaagaccgtggaccttggtcagtgtgggctgctggggactatcaccgggcctccccaatgcgaccagttcctcgagttctctgcagatctgattattgagcggcgcgagggtagtgatgtgtgctaccctggcaaattcgtgaatgaggaggcactgagacagatcctgagagagagtggcggaatcgataaagaagcaatggggtttacctattccgggatacggactaacggggcaacatcggcttgcaggcgaagtggctcatctttctacgccgaaatgaagtggctcctgagcaacaccgataatgccgctttcccacagatgactaagtcctataagaacacccggaagagcccggccttgattgtctgggggatccaccattctgtcagtacagctgaacaaactaagttgtacggttccggaaacaagctggtgaccgtgggatctagcaattatcagcagtcattcgtgccttcacctggcgcacgaccacaggtcaatggacagagtggtagaatcgactttcactggctgatgcttaatccgaatgacaccgtgaccttctccttcaacggagcctttattgcccctgaccgagctagctttctcaggggaaagtctatgggcatacagagcggcgtgcaggtcgacgcaaattgtgaaggggactgttaccactcaggcgggaccattataagtaatctgccttttcagaacattgacagcagagcggtgggcaaatgtccgcgttacgtgaagcagagatcactgctcttggccaccggcatgaagaatgtccctgagatcccgaaaggcaggggtctgtttggggctattgcgggcttcattgaaaacggctgggaaggtctcatcgatggttggtacggattccggcaccagaatgctcagggggagggcaccgccgccgattataagagtacccagtctgccatcgaccaaatcaccggcaagcttaaccgtcttatcgagaaaacaaatcagcagttcgagctgatcgataacgaatttaatgaggtagagaaacagattggtaatgtgattaactggacacgcgactccattaccgaggtgtggtcgtataatgcagaattactggtggccatggagaatcaacacaccattgatctggccgatagcgagatggacaagctgtatgagagagtgaagagacaactgagggaaaacgcggaggaggatggaacaggatgtttcgagatcttccacaagtgtgacgacgattgcatggcgagtatccggaacaacacctacgatcattcaaaatatcgagaggaagctatgcaaaaccgaattcagatcgatccagtaaaattatcttcagggtataaggatgtcatactatggttcagcttcggggcgtcgtgcttcatcttgctggctatcgtcatggggctcgtctttatttgtgtgaaaaatggaaatatgcggtgcacgatctgcatt

SEQ ID NO: 617 - DNA, 1680 bp, Influenza A virus
  misc_feature (1)..(1680): Codon Optimized Sequence Encoding H7 Hemagglutinin
atgaacacgcaaatcctggtatttgcgctgatcgctatcattcccactaatgctgacaaaatctgtctgggccatcacgctgtgtcaaacggaaccaaggtgaatacgctgaccgaacgcggcgtcgaggtggtcaatgccacggaaacagtcgaaagaacaaacattcccagaatctgctcaaagggtaaaaagacggtagatctcgggcagtgtgggcttcttggaacaatcactggcccaccacaatgcgatcaatttctcgaattcagcgccgacctgatcatcgagaggagggaaggtagtgatgtgtgctaccccgggaagtttgtgaatgaggaggcattgcgccaaatactgagagagagcggagggattgacaaggaggccatgggattcacctacagcgggatcagaactaatggagccacgagcgcttgcaggaggagtggaagcagcttttatgctgaaatgaagtggctactgtccaatacggataacgctgcgttcccacaaatgacaaagtcgtacaagaatacgcgaaagagcccagccctcattgtctggggtatccatcacagcgtgagtaccgcagaacaaaccaaactttacgggtcaggtaacaaactggtaaccgttggaagctccaattatcagcaatcgttcgttccttcacctggggctcgcccacaagtcaatggacagagcggcagaattgacttccattggctcatgctcaatccaaacgatacagtcaccttttcatttaacggagctttcatcgctcctgatcgggctagctttctaaggggcaagtctatgggtattcagtccggcgtacaagtcgacgccaactgtgagggggactgctaccatagcggaggcactatcatatcaaatctccccttccagaatatcgactccagggctgttggtaagtgcccaagatacgtgaagcagagatccctccttctggctacaggcatgaaaaatgtgccagaaattccaaagggacggggcctatttggagctattgcaggcttcatcgagaacggatgggaaggactgatcgatgggtggtacggatttaggcaccagaacgcccagggagagggaacagctgctgactacaaatctacccagtctgcaattgatcagatcaccggtaaactgaatagactgattgagaaaactaaccagcagttcgagctaattgataatgagttcaatgaagtggagaagcagatcggcaacgtgattaactggaccagagattcaatcacggaggtctggtcttacaacgccgagttgctggtggctatggaaaaccagcacaccatagacctggccgactctgaaatggacaaattgtacgagagggtaaaaaggcagctccgagaaaacgccgaggaggacggtactggctgctttgagatatttcacaagtgcgacgatgattgcatggcctccattcgaaacaacacgtacgaccacagtaaatacagggaggaagccatgcagaaccgcatccagattgaccctgtcaagctgagtagtggctacaaggacgttatcctctggtttagttttggagcatcatgttttatactgttggcaatagtcatggggcttgtcttcatctgcgtgaaaaatggcaacatgcgttgtacaatctgcatt

SEQ ID NO: 618 - DNA, 1680 bp, Influenza A virus
  misc_feature (1)..(1680): Codon Optimized Sequence Encoding H7 Hemagglutinin
atgaatacccaaattctggtgttcgctctaattgccatcataccaacaaacgcagacaagatttgtctgggccaccacgccgtgtcaaacggaacgaaagtgaacactctgactgagcgtggcgtggaggtagtgaacgctaccgaaactgtggagcggactaatatcccaaggatctgtagcaagggaaaaaagacagtggacctgggtcagtgcggattgctaggaaccataaccggtccacctcagtgcgatcagtttttggagtttagcgccgatctcatcatcgaaagaagggagggttctgatgtttgttacccaggaaaatttgttaacgaagaagcccttcgccagatccttagagaatcaggcggcatcgataaagaggcaatggggttcacctattcaggaatacgcacaaatggcgccacgagcgcgtgcaggcgcagcgggagttcattttatgctgaaatgaaatggctcctctcaaacactgataacgctgcatttccacaaatgacgaaaagttataagaatacgagaaagtctccagccctcattgtctggggcattcatcactcagtgtcgactgccgagcaaaccaagctgtacggcagcggtaacaaattggtaactgtcggcagtagtaactaccagcaaagttttgtgcctagccccggcgctcggccacaagtgaacggacagagcgggcgcatcgattttcactggctgatgctaaatccaaatgacacagtcaccttttcgtttaacggggccttcatcgcccctgaccgggcttctttcctgagaggaaaaagcatgggaatccagtccggagtccaggttgacgccaactgcgaaggagactgttatcattccgggggcactattataagcaatctgccttttcagaacatagatagtcgcgccgtaggcaagtgtccccgctacgtcaaacagagaagccttctgctggctaccggtatgaagaacgtccccgaaatccctaaaggccgaggactattcggcgctatcgccggcttcattgaaaatggctgggagggcttgatagatgggtggtatggctttcgccatcagaatgcacagggtgaagggactgcagccgattataaatctactcagtccgccatcgatcagattaccgggaagctcaatagactcattgagaagacaaatcaacagttcgaactgatcgataacgagttcaacgaggtagagaaacagatcgggaatgtcattaactggacccgagattctatcacagaagtttggtcttacaacgcggagctgctggtcgcaatggaaaatcagcataccatcgatctggccgattcagaaatggacaagctttatgagagagtgaagcgccagttgcgcgagaatgcggaagaggacggcaccggatgcttcgagatttttcacaaatgtgatgatgattgtatggcttcgattcggaataacacctacgatcactccaaatatcgcgaagaggctatgcagaacagaatacaaatcgatcccgtcaaacttagcagcggctacaaagacgtcattctgtggttttccttcggggcatcctgttttatactgctggccatagtgatgggtctggtgtttatatgtgtaaagaacggcaacatgcgctgtaccatttgcatc

SEQ ID NO: 619 - DNA, 1680 bp, Influenza A virus
  misc_feature (1)..(1680): Codon Optimized Sequence Encoding H7 Hemagglutinin
atgaacacccagatcctcgtgttcgccttaatcgctatcattccaaccaatgcagacaagatatgtctgggtcatcatgccgttagcaatggcaccaaggtcaacaccctgaccgagcgcggagtcgaggttgttaatgcaaccgaaactgtggagcggacaaatattccccggatctgcagcaaggggaagaggacagtcgatctgggccaatgcggactgctgggcacaatcaccggaccccctcagtgcgatcaatttctggagttcagcgccgacctgatcatcgagagaagggaggggagtgacgtatgttacccagggaagtttgtgaacgaggaggccctgagacagattctgagagaaagcggcggcatcgataaagaggccatgggatttacctatagcggcattcgcaccaatggagccacttcagcttgtaggagatccgggagtagcttttacgctgagatgaaatggctgctttccaatactgataatgccgctttcccacagatgactaagtcttataagaatactcgcaagagtcctgccctgatagtctggggcatccatcattccgtctcaaccgctgaacagaccaaactctacgggtctgggaacaagttggtgaccgtgggctcctcgaattatcaacaatcattcgtgccgtcccccggcgctcggccgcaggttaacggtctttcaggccgcatcgacttccactggctaatgttgaacccaaacgatactgttacttttagctttaacggcgcatttattgcccccgaccgggcctccttcctgcgaggcaagtccatgggtatccagtctggagtccaagtggatgctaactgtgaaggcgactgttaccatagtggagggacaattattagtaacctgcccttccagaacattgacagtagggccgtgggcaaatgcccacggtacgtgaagcagcggtccctgctgctggcaactggaatgaagaacgtgccagagatccctaaagggcggggcctcttcggcgctatcgccgggtttatagagaatggttgggaagggctgatcgatggatggtatgggttccgccaccagaatgctcagggtgaggggacagctgctgactacaagtctacacagagtgctattgaccagatcaccggaaaacttaacaggatcatcgagaaaacgaatcagcaatttgagctcattgataacgagttcaatgaagtcgagaagcaaatcgggaacgtgataaattggacacgcgactccatcactgaggtctggagctataacgccgagcttctggtggcaatggagaatcagcatactatcgatctcgcggattccgaaatggataagctctacgagagagttaagaggcagctccgcgagaatgccgaggaagatgggaccggatgcttcgagatattccataagtgcgacgacgactgcatggcgtcaataaggaataatacttatgatcattctaagtacagggaggaggccatgcagaatcgcattcagattgatcctgttaaactaagctcaggctataaggacgtaatattatggttttcttttggcgcttcctgttttatcctcctggctatagttatggggctggtgtttatttgtgttaaaaatggaaatatgagatgcacaatttgcatc

SEQ ID NO: 620 - DNA, 1680 bp, Influenza A virus
  misc_feature (1)..(1680): Codon Optimized Sequence Encoding H7 Hemagglutinin
atgaatacccaaattctggtcttcgctctgatagctataatcccaacgaatgccgataagatatgtctgggtcatcacgctgtctccaatgggaccaaagtgaacacattgactgaacgcggcgtggaggtggttaacgccactgagaccgtagagcggactaatataccccggatctgcagtaagggaaaaaagacagtcgacttgggtcagtgcggcctgctagggaccatcacagggcctcctcaatgtgaccagttcctggagttcagcgcagaccttataatcgaaagaagagaggggtcggacgtctgttaccccggcaagtttgtgaacgaggaagcactgaggcagatcctgagagaatccggcggaattgataaggaagccatgggtttcacctacagtggcatacgcaccaatggagcaacatccgcttgtagacggagcggttcttccttttacgccgagatgaagtggctgctgtccaacacggataatgcagccttccctcaaatgactaagagttataagaatacgagaaagtcccccgccttgattgtgtgggggatccaccatagcgttagcacagccgaacagactaagctttacggttcaggcaacaagctcgtaaccgtgggatcctccaattatcagcaatccttcgtgccttctcctggcgcccgccctcaggttaacggtcaaagcggtcgcatagattttcattggctcatgctgaacccgaatgatacagtcacgttttctttcaatggggcatttatcgcaccagaccgggcctcctttcttcgcgggaagtctatgggaatacaatccggcgtacaggttgatgctaactgcgagggcgactgttatcattcagggggtaccataatctccaacttgcctttccaaaatattgattcccgggctgtcggaaagtgcccgagatatgtgaagcaacgcagtttactcctggccacgggaatgaaaaacgttcccgaaatccctaagggaaggggactatttggtgctattgcagggtttattgagaatggctgggagggcttaatcgacggctggtatggcttccgccaccaaaacgcacagggggaggggacagcagcagactataaaagcacgcagagcgcaatcgaccaaattaccggcaagttgaataggctcattgaaaaaacaaaccagcaatttgagctcatcgacaacgagttcaatgaagttgagaaacagataggaaatgtgatcaattggactcgcgacagcattaccgaggtatggtcatacaacgcagagctcttagtggcgatggagaaccagcacaccatcgatctagccgacagtgagatggacaagctgtacgaacgagtcaagagacagttacgagagaatgccgaggaggacggaaccggctgctttgagattttccacaagtgtgacgatgactgtatggctagcattcgcaataatacctatgaccacagtaaataccgggaggaggctatgcagaatcgtattcagatcgatcctgtgaagctgtctagtggatacaaggacgtaatcctgtggttttctttcggtgcttcttgtttcatcctgttagcaatagtaatgggtctggtatttatctgcgttaagaacggaaatatgcggtgtactatttgcatc

SEQ ID NO: 621 - DNA, 1680 bp, Influenza A virus
  misc_feature (1)..(1680): Codon Optimized Sequence Encoding H7 Hemagglutinin
atgaacacacagatactggtctttgctcttatcgctatcattcccaccaatgccgataaaatctgcttggggcaccacgccgtgtccaacgggacgaaagttaatacactcactgagcgaggcgtggaggtcgtcaacgccacagagacggtggagcgcaccaacatcccgaggatctgcagcaagggcaaacgaaccgtcgatcttgggcagtgcgggctgttgggcaccattacgggacctccccagtgtgatcagttcttggagttttctgctgacctcatcattgagagaagggaaggcagcgacgtgtgctatcccggcaagttcgtgaaagaagaggccctgcggcagatactgcgggagtcaggcggtattgataaagaagcgatgggcttcacgtacagcggtatcaggactaacggcgctaccagcgcttgccgacggagcggtagctctttctacgccgagatgaaatggttactttctaacaccgataacgctgcgtttccacagatgacgaaatcctacaagaatactagaaaaagtccagccctgatcgtttggggaattcaccactctgtctccacagctgaacagaccaagttgtatggctccggcaacaagctggttacagtaggctccagcaattaccagcagtcttttgtcccctcccctggagctcgtccacaggtcaatggactgtcaggccgaatcgacttccactggctgatgttgaatccaaacgatacagtgactttctcatttaatggcgcttttattgccccagatcgggccagtttcctcagaggtaagtccatgggaatccagtcgggggtccaagtcgatgccaactgcgaaggcgactgttaccacagcggcggtaccattatctccaacctgcccttccaaaacatcgactctcgggcagttggaaaatgtccaaggtacgtcaagcagagatccctgctgctggccacaggcatgaagaacgtgcccgagattcccaaaggacggggcctattcggagcgatcgcaggattcattgagaacggatgggagggcttgattgatggctggtacggctttagacaccaaaatgctcagggggagggcactgccgccgactacaaatctactcagtcggcgattgaccagattactggaaagttgaaccggctcattgaaaaaaccaaccagcagttcgaattgattgataatgagttcaatgaagtggaaaaacagatcgggaatgtgattaactggaccagagactccatcacagaggtttggagctacaacgcggaattactagttgccatggaaaatcagcacaccattgacctcgctgacagtgagatggataaactgtacgagcgcgtgaaaagacagctacgcgagaatgcggaagaagacggcacaggatgctttgagatctttcacaagtgcgacgatgattgcatggcttcgattcggaataatacctacgatcactccaaatatagagaggaggctatgcaaaatcgaattcagatcgaccccgtcaagttgtcctccggctacaaggacgttatcttgtggttctcctttggcgcatcatgcttcattttgctggccatagtcatgggcctggtattcatttgtgtcaagaatggaaatatgaggtgcaccatatgcatc

SEQ ID NO: 622 - DNA, 1680 bp, Influenza A virus
  misc_feature (1)..(1680): Codon Optimized Sequence Encoding H7 Hemagglutinin
atgaatacccagattcttgtgttcgctctgatcgcgattattcctaccaacgctgataaaatctgcctcggacatcacgctgttagcaacggaaccaaggtgaacacactgacagagcgcggggtcgaagttgtcaacgctactgagacggtggaacggaccaacataccacggatctgctctaagggcaagcgaactgtggatctcgggcagtgtggcttgctgggaacgattacgggccctcctcagtgtgatcagtttctcgagttctctgcagatctgataatcgagagaagggaaggatcagatgtctgctaccctgggaaattcgtgaaagaagaagcactgagacaaatcttacgcgagtcagggggcatagataaggaagccatgggcttcacatactctgggatccgtaccaacggcgccacgtcagcttgtcgtaggtctggctcttctttctatgccgagatgaaatggctcctgtcgaatactgacaatgctgcgttcccccagatgactaagagctacaaaaatacaagaaagtctcccgcgctgatagtttgggggattcaccactctgtctccactgccgaacagacaaagttatacggcagcggtaacaagctagtgacagttgggagctcaaactatcaacaatcatttgtaccatcccccggtgccaggccacaggtaaacggcctttccggacgtatcgactttcactggctgatgctgaatcccaatgataccgtaactttttccttcaacggggcttttattgccccagatagggcatcctttctgcgaggtaagagtatgggcatacagagcggcgtgcaagtggacgctaattgtgagggggactgctaccattccgggggaaccatcatctcgaatttaccgtttcagaacatcgattcacgcgctgttgggaagtgtcctaggtatgtaaaacagcgatcccttcttctggccacaggcatgaagaacgtaccagagatacctaaaggacggggactgttcggggccattgcagggttcatcgaaaacggctgggaaggcctgatcgacggctggtatggctttcggcatcagaacgcccagggagagggtactgcagccgattataagagtacacagtctgcaatcgaccaaattacaggaaagctgaatagactcatagagaagacaaatcagcagtttgaactcattgacaatgagttcaatgaagtggaaaagcaaatcgggaacgtgattaattggaccagggatagcataacagaagtctggtcctataacgctgaactacttgttgcaatggagaaccagcacactatcgatctggcagactctgaaatggacaaactgtatgagagggttaaacgccaactgagagagaatgctgaggaagacggtactggctgttttgagattttccacaaatgtgacgacgattgtatggcgtccatcaggaacaacacctatgaccattctaaatatagagaggaagccatgcagaatcggatacagattgatcctgtgaaacttagctctggatataaggacgtgatcctgtggttttcatttggagcgtcatgctttatcctgctggccatcgtgatgggattggtcttcatatgtgtcaagaatggcaatatgcggtgtaccatatgtatt

SEQ ID NO: 623 - DNA, 1680 bp, Influenza A virus
  misc_feature (1)..(1680): Codon Optimized Sequence Encoding H7 Hemagglutinin
atgaatacacagatactcgtgtttgccctcattgccatcatccctaccaatgcagataagatctgcctcggccaccatgctgttagcaacggaaccaaggttaacaccctcactgaacgaggagtggaggtcgttaacgccacagaaaccgtggaacggacgaacatcccccgcatctgcagcaaaggcaagcgcaccgtggatctggggcagtgcggcctgctgggcacgattacagggcccccccaatgcgaccagtttttggagttcagcgcagacctgatcattgaaaggcgtgaggggagtgacgtgtgttatcccggtaaatttgtgaacgaagaggccctcagacagatcctgcgggagtctggtgggatcgataaagaggcaatgggcttcacttattctggaatccggaccaacggggccacctctgcgtgcaggcgttccggcagctcattctatgcagagatgaaatggctacttagtaacacggacaacgcagctttcccccagatgactaaaagttacaagaacactcgaaagagtccagcactcattgtgtgggggattcatcattccgtgtctaccgccgagcagactaaactatacggtagtgggaataaactagtaaccgtcggctcttctaactaccagcagtcttttgtgccctctccaggtgaacgcccccaggtcaacgggctgtctggtcgcatcgactttcattggctgatgctcaaccctaatgacacagtcacgttcagtttcaatggtgctttcattgcacccgatagggcctcatttcttcggggcaagtccatgggcatccaaagtggagttcaggtggacgccaattgcgaaggtgactgctatcacagtggcggcacaatcatttctaacctgccgtttcagaatattgactcccgtgctgtagggaagtgtccccgatacgtgaagcagcggtccttgcttctggcaaccggtatgaagaatgtccctgagattcctaaaggccgggggctgttcggagctattgcagggttcatcgaaaacggctgggaggggctcatcgatggttggtacggattcagacatcaaaatgcacaaggggaaggaaccgcagccgactataagagcacacaaagcgctatcgatcagatcaccgggaaattaaaccgcctgattgagaaaaccaatcagcagttcgagcttattgacaacgaattcaatgaggtggaaaaacagatagggaatgtgatcaactggaccagagattctatcaccgaggtttggtcttataacgcggaactgctggttgctatggagaatcagcataccatcgacctggctgacagcgagatggataagttatacgagcgtgtcaaacgacagctgagggagaatgcggaggaggatggaaccgggtgtttcgagatcttccataaatgtgacgatgactgcatggccagtattcggaacaatacatatgaccattccaaataccgcgaagaggcaatgcagaatcgaatacagatagatcctgtgaaactgagcagcgggtataaagacgtcatcttgtggtttagttttggggcatcctgctttattctgctcgccatagtgatggggttagtgtttatatgtgttaaaaacggaaatatgcggtgtacaatttgtatc

SEQ ID NO: 624 - DNA, 1680 bp, Influenza A virus
  misc_feature (1)..(1680): Codon Optimized Sequence Encoding H7 Hemagglutinin
atgaatacccagattcttgtgtttgccctgatcgctataatacctactaatgcagataagatctgtttaggacatcacgccgtctccaatggaactaaggtaaacacgctgaccgagcggggcgtcgaggtggtgaacgcaaccgaaactgttgagcgcaccaatattccccggatatgctcaaaggggaagcgaaccgttgacctaggccaatgcggcttgctggggacaattaccggaccaccccaatgtgaccagtttctggaattttcagccgacctaatcatcgagcgacgcgagggcagcgacgtgtgttatcccggtaagtttgtcaatgaggaagccctgaggcagatacttagagaatcgggcgggatcgacaaggaggccatggggttcacatatagtggtatccgcactaatggagctacatccgcctgtcggaggagcgggagctccttctacgctgaaatgaagtggctcctcagtaacacggataacgctgctttcccccagatgactaaaagctataaaaacactagaaagagcccagcactcattgtgtggggtattcaccactcagtgtctacggccgaacaaacaaaattatatggatccgggaacaagctggtaaccgtcggaagtagcaattatcagcagtcctttgtgccaagcccgggagcccggccccaggtgaacggcctatctgggcggatcgattttcattggcttatgctcaaccctaacgacaccgttacctttagcttcaacggggctttcattgcacccgaccgtgcatcattcctgcgtgggaagagcatggggatacagagcggcgtacaggtggacgcgaactgcgaaggcgactgttaccattcaggcggcaccattatttccaatttgccgtttcagaacatcgactcacgcgccgtaggaaaatgtccccggtacgtcaaacagcgcagcctcctactagccaccgggatgaaaaacgtgcccgagatccccaagggacggggactattcggagcgatagccgggttcattgagaatggatgggagggtctgatcgatggctggtacgggttccggcatcaaaacgcacagggcgaggggactgcagccgattacaaatctacccaatcggcaatcgaccagattacaggcaaactgaataggatcatagagaaaaccaatcagcagttcgaactgattgacaatgagtttaatgaagtagagaagcagattgggaatgtgataaattggactcgagacagcattaccgaagtctggtcttacaatgccgagttactcgtcgctatggagaaccagcacaccattgacctggccgactcagagatggacaaactctatgagcgcgtaaagagacaattgagggaaaacgcggaggaagacggaacaggctgtttcgaaatatttcacaagtgcgacgacgactgtatggcatccatccggaataatacctatgatcacagcaagtacagggaggaggctatgcaaaatcggatccagattgatcctgtaaaactgagctcgggatacaaggatgttatcctgtggtttagtttcggcgccagctgctttattctccttgccatcgtcatgggcctggtcttcatctgcgtcaaaaatggaaatatgagatgcacaatttgcatt

SEQ ID NO: 625 - DNA, 1680 bp, Influenza A virus
  misc_feature (1)..(1680): Codon Optimized Sequence Encoding H7 Hemagglutinin
atgaacactcaaattctcgtgtttgctctaattgccatcatcccgacaaatgcagataagatttgcctgggtcaccatgcggtgtctaatggaacaaaggttaataccctgaccgaaaggggcgtggaggtcgtgaatgccaccgagacggtggaaagaaccaacattccaagaatttgctccaaaggaaagaaaaccgtcgacctgggtcagtgcggattgctgggaacaatcaccgggccaccccagtgcgaccagttcctggaattcagcgccgacctcattattgagcgcagagaaggttctgacgtgtgttatccagggaagttcgtgaacgaggaggcactgcggcaaatcctgcgtgaaagcggcggcattgacaaggaggcgatgggctttacatactccgggatccgtacaaacggggccactagtgcgtgcagaagatctggaagcagcttttatgctgaaatgaaatggttgctctccaacacggacaacgctgccttcccccagatgacaaagagctacaaaaatactcgaaaaagccccgccctaatagtgtggggcatccaccattctgtgagcaccgccgaacagaccaagctgtatggcagcggtaacaaattggttaccgtaggctcttctaactatcagcagagcttcgtcccatcgcctggtgccaggccccaggtcaacggccaaagcggtcggattgattttcactggttaatgcttaatccaaatgatacagtgacctttagttttaacggagctttcatcgcccccgatcgggcgagctttctccgggggaaatccatgggaatccagtctggggtgcaggtggacgctaattgcgagggcgactgctaccactccggggggaccatcataagtaacctccctttccaaaacatcgattcacgagctgtgggaaaatgcccccgttacgtaaaacagcgttctctcttattggccacaggtatgaaaaatgtgccagaaattcctaagggccgggggctcttcggcgccatagccggattcattgagaatgggtgggaaggtctgatcgacgggtggtacggtttccgacaccagaacgcacagggagagggtacggctgcagattacaagtctactcagtcagctattgaccagatcaccggcaagctgaataggcttatcgagaaaacaaaccaacagtttgaactgatcgacaatgagtttaacgaggtcgagaagcagatcggcaacgttattaactggactagagactccatcaccgaagtgtggagctacaatgccgagctgctagtggctatggagaatcaacataccattgatctggccgatagtgagatggacaagctgtatgaacgagtcaagcgacaactacgcgaaaatgcggaagaagatgggacaggatgttttgagattttccacaaatgcgatgacgattgtatggccagcatccggaacaacacatacgatcatagcaaatacagagaggaggccatgcaaaatcgcattcaaatagaccctgtcaagcttagctccgggtataaagacgtgattctatggttctcgtttggggcctcatgtttcattctgctggccatcgtcatgggcctcgtgtttatttgcgtaaagaatggcaacatgcgctgtaccatctgtatt

SEQ ID NO: 626 - DNA, 1680 bp, Influenza A virus
  misc_feature (1)..(1680): Codon Optimized Sequence Encoding H7 Hemagglutinin
atgaacactcagattctggtgtttgctctgatcgcgattatccccactaatgccgacaagatatgtctcggtcatcatgcggtttctaacgggacgaaggtgaacacattgacagagcgaggggtggaggtggttaatgcgactgagactgtagaaaggaccaatattccgcgtatttgtagcaagggtaagaaaactgttgacttgggacaatgtggtctgctcggaaccattactggcccccctcagtgtgatcaattcctggagttcagcgccgatctgattatagagcgaagagagggtagcgatgtttgctatcccgggaaatttgtaaacgaggaggccctccgccaaatcctacgagagtcaggtgggattgacaaggaggctatggggttcacctatagtggaatccggaccaatggggcaacttctgcctgtcggagatctggctcgagcttctacgcggagatgaagtggttgctgagtaacactgataacgctgcgtttccccaaatgaccaagtcgtataaaaatacaagaaagagtcctgctctgatcgtgtggggaatccatcactctgtaagcacggccgagcaaactaaactttatggatcgggcaataaacttgtcacagtgggcagcagcaactaccagcaatcatttgtgccttctccgggcgcgagaccacaggtcaatggccagtctgggaggatcgattttcactggctcatgctaaatcccaacgacacagtgacctttagctttaatggcgcatttattgcacctgatagagcgtcattccttaggggaaaaagcatggggatacaatcaggggtccaggtcgacgctaattgcgagggcgactgctaccactcagggggtaccatcatatctaatcttccattccagaacatcgactcgcgagccgttggaaagtgccccaggtacgtgaagcagcggagtctgctcctggcaactggcatgaagaacgtgcctgagatccccaaaggccgtggcttatttggagctatcgcagggtttatcgagaatggctgggagggattgatcgatggttggtatggctttcggcaccaaaatgcccagggagagggaaccgccgccgattataagtcaactcagagtgcgatagatcagattacaggtaagctaaatagactgattgagaagactaaccaacagttcgagcttatcgacaacgaatttaatgaagtggaaaagcaaataggaaacgttatcaactggacacgcgatagcatcacagaagtttggtcttacaacgccgagctcttggtggctatggagaatcaacatacaatcgacctggcagatagcgaaatggataagttatacgaacgggtcaagcgacagctgagggagaacgctgaagaggatggaactggctgttttgagatcttccacaagtgcgatgatgactgtatggcaagcatacgaaacaacacttacgatcattcaaagtaccgggaggaggccatgcaaaacaggattcagattgatccagtgaagttgtcctctggctacaaggatgtgatactgtggttttccttcggagcaagctgctttatcttactggcaattgtgatgggactcgtgtttatatgcgtgaaaaatggaaatatgcgctgtacaatctgcatc

SEQ ID NO: 627 - DNA, 1680 bp, Influenza A virus
  misc_feature (1)..(1680): Codon Optimized Sequence Encoding H7 Hemagglutinin
atgaacacgcagatacttgtgtttgcccttattgccattattcccactaacgcggacaaaatatgcctgggccatcacgctgtctccaatgggacgaaagtgaacacattgaccgagcgaggcgtggaagtggtaaatgcgaccgaaaccgtagagagaaccaacattcctagaatttgctccaagggcaaacggacagtagatctggggcagtgcggactgttgggtacaattacaggacctccccagtgcgatcagttcctggagttttccgctgatctgattatagaaaggcgagagggttccgacgtgtgctaccctggtaagtttgttaaagaggaagctctccgtcagattctccgagagtctggcgggatcgataaagaggcgatggggtttacctactctggaataaggaccaacggagcaacctccgcctgcaggagatcagggtcgtccttctatgctgaaatgaaatggttgctgtctaataccgacaatgcagccttcccccagatgaccaaaagctacaagaatacacgcaaatctcccgccctgattgtgtggggcatacaccatagtgtgagtactgcagaacagaccaagctttacggatccggcaataagctggtgactgtaggctctagcaactaccaacagagctttgtaccatcccccggtgcacgccctcaggtgaacggactctcggggcggatagatttccactggttgatgttgaatcccaacgacaccgtgacgttcagtttcaacggtgctttcatcgcgcctgatagggcctctttcttaagagggaaatcaatgggcatccagagcggggttcaggtagacgctaactgtgagggtgactgctatcatagcggcggcactattatatctaacctgcccttccagaatatcgactcccgggccgtgggaaaatgcccaaggtatgtgaaacagaggtcactgctactggcgaccgggatgaagaacgttccagaaatacctaaaggtcgtgggctgttcggcgcaattgccggtttcattgaaaacggctgggagggcctgatcgacggatggtatgggttcagacaccagaacgcccagggagagggcacagctgccgactataagtccacacaaagcgccattgatcagatcacaggcaagcttaacagactgatcgagaagacaaaccagcaatttgagttgatagacaacgagttcaacgaagtggagaagcaaatcgggaacgtcattaattggacccgggattctatcaccgaagtatggtcatacaacgccgagctgctcgtggctatggagaatcagcataccattgatcttgccgattccgagatggacaagctgtatgaaagagtcaaacgacagttgcgagaaaacgctgaagaggacggaacaggatgctttgaaatctttcacaaatgtgacgacgactgtatggcaagcattcggaacaatacctatgatcactcaaagtaccgagaggaggccatgcagaataggattcagatcgacccagtcaagctctcctccgggtacaaagatgtaatcctgtggttttcgttcggcgccagttgtttcatcttactggccatagtcatgggcctggtctttatctgcgttaagaacggcaacatgcgctgcactatttgcatc

SEQ ID NO: 628 - DNA, 1680 bp, Influenza A virus
  misc_feature (1)..(1680): Codon Optimized Sequence Encoding H7 Hemagglutinin
atgaacacccagatacttgtttttgccctgattgccatcatcccaaccaacgccgacaagatctgcttggggcaccatgctgttagcaacggaacaaaagtgaacaccctgaccgaaagaggcgtcgaggtagtaaacgccactgaaacggtcgagcgaaccaatatacctaggatatgttcaaagggaaaaaggacggttgatttaggtcagtgtggacttctggggacaatcaccggaccaccccaatgtgaccagttccttgagttcagcgcggacctgattattgagagacgtgaaggatctgacgtctgctacccaggaaagtttgtgaatgaggaagcactccgccagattctcagggaatccggcggcattgataaagaggcaatgggatttacctactccggcattcggactaacggtgctacatctgcatgtagacggtccggctcttcattctatgcagagatgaaatggctgctttcaaatactgataacgccgcctttcctcagatgaccaaatcctacaagaacacccggaaatcccccgccctcattgtttgggggatccaccactcagtgtcaaccgccgagcagaccaagctctacggaagtggaaataagttggtaactgtgggaagctctaactaccagcaaagctttgtgccaagtcctggagagaggccccaggtgaacggacttagcggtaggatcgattttcattggcttatgctcaaccccaacgatacggtcaccttttcattcaatggggcctttattgcaccggatagagccagctttctgagagggaagtctatgggcatccagtcgggcgtacaggtggatgcaaactgtgagggggattgctatcatagtggaggcaccatcataagtaatctgcccttccagaatatcgatagccgggccgtgggcaaatgtccaaggtatgtgaaacagaggtcactgctgctcgctacaggcatgaaaaacgtgcctgaaatacccaaaggacgggggcttttcggcgccatcgccggcttcattgagaacggatgggaaggtttgatcgatggatggtatggatttaggcaccaaaacgcccagggggaaggcaccgccgcggactacaagagtactcagtctgcaatcgaccaaatcactggcaaactgaatcggctgattgagaagaccaatcagcaattcgaactcattgacaacgagtttaatgaagtggagaaacagatcggtaacgtgataaattggaccagagactcgatcacggaagtatggagctacaatgctgaactgttggtcgctatggagaatcaacacactatcgacctggccgacagcgagatggataaactctatgaaagagtgaaacggcagctcagagagaacgcagaggaggacggaaccggctgctttgaaatattccataaatgcgacgacgattgcatggccagcatcaggaacaatacctatgatcatagcaagtaccgggaggaagccatgcagaatagaattcagatcgacccagtgaaactgtctagcggatataaggacgtgattctgtggttctcattcggcgcctcatgcttcattctattggcgattgtgatgggacttgtgttcatctgcgtcaaaaatggcaatatgcggtgcacgatatgtatc

SEQ ID NO: 629 - DNA, 1680 bp, Influenza A virus
  misc_feature (1)..(1680): Codon Optimized Sequence Encoding H7 Hemagglutinin
atgaacacccaaattctggtctttgctctgatcgcaattatcccaaccaatgctgacaaaatttgcctcggacatcatgcggtatccaacggcacaaaggtaaacactctcactgaacgcggagttgaggtggtaaatgccacggaaacagttgagaggactaatatacctagaatttgtagcaaaggaaaaaaaacggtggacctcgggcagtgtggcctgcttggaacaattacaggcccgccccagtgcgaccagttcctagaattctccgccgatctgatcatcgaacgccgcgaaggaagcgatgtgtgttatccaggcaagtttgtgaatgaggaggccctgagacaaatcctgcgggagagcggcggaattgataaagaggcaatgggattcacttacagtgggatccggacaaacggggccacgtcggcctgcagacgtagcgggagttccttctatgccgaaatgaagtggctgctgtccaacactgacaacgcggcctttccacaaatgactaaatcttataaaaacacacggaagtcaccagctctcatcgtgtggggtatccaccattcggtctctacagctgagcaaactaagctttacggaagtggcaacaaactggtgacagtgggcagctctaactaccagcagtcatttgtcccgtctcccggggccagaccacaggttaatgggcagtcaggccggatcgattttcattggttgatgttaaacccaaacgacacagtcacatttagttttaatggggcatttatagcccctgatagagctagtttcttgaggggaaagagtatggggatccagtcaggtgtacaggtcgacgccaactgcgagggtgactgttaccattccgggggtaccatcattagtaacctgcctttccagaacatcgacagtagagcagtgggtaaatgcccaaggtacgtgaaacaacgcagcttactgctggctacaggaatgaaaaacgtgcccgagattccaaaagggaggggtttgttcggtgctattgccggttttattgaaaacggatgggagggtctcatcgatggatggtatgggtttaggcaccagaatgcacaaggggaaggaactgccgccgattataaatccacccagtccgctattgaccagattaccggtaaactgaatcgtttgattgagaaaacaaaccagcagtttgaactaatcgacaacgaattcaatgaagtggagaagcagattggtaacgtcattaactggacccgtgacagtatcactgaagtttggtcttataatgccgaactcctagtagcgatggagaaccagcacaccatagacctcgccgatagtgaaatggacaaactgtatgagagagtgaagcggcagttacgcgaaaacgctgaggaggacgggactggctgcttcgagatttttcacaagtgcgacgacgactgcatggcatcaatccgcaacaatacatacgatcattccaagtatcgtgaagaagccatgcagaaccggatccaaatagaccctgtcaaacttagcagcgggtataaagatgttattctgtggtttagctttggagccagttgtttcatactgctggccattgttatgggcctcgtcttcatctgcgtgaaaaacgggaacatgcgatgtacgatctgcatt

SEQ ID NO: 630 - DNA, 1680 bp, Influenza A virus
  misc_feature (1)..(1680): Codon Optimized Sequence Encoding H7 Hemagglutinin
atgaacactcaaattttagtcttcgccctcattgcgataatccctactaacgcagacaagatctgtctgggacaccacgccgtgtctaatggcaccaaagtgaacacattgacggagagaggagtagaggtggtgaacgccaccgagaccgtcgagagaaccaatatacctaggatctgcagcaagggaaagaagactgtcgatctgggccaatgcgggttgctcgggactattactggacctccgcaatgtgaccagttccttgaattctctgctgacctgataatcgaacgacgagagggatccgatgtttgctatccagggaagtttgtgaatgaggaggctctcagacaaatcctgcgggagtccggcggcatcgacaaagaagccatgggtttcacctatagtggaattcggaccaatggcgcaaccagcgcatgccggcgtagtggaagctccttttatgccgagatgaagtggttactttccaataccgataacgcagcattccctcagatgaccaaaagttacaagaacactcgtaaatctcctgctcttattgtatgggggatacaccacagtgtgagcaccgccgagcaaactaagctttacggatcagggaataagcttgtaacagtgggaagctctaactaccaacagtcctttgttccatctcccggggcgagacctcaagtaaacgggcaatctggtaggatagactttcattggctgatgctgaatccgaatgatacagttaccttctcctttaatggagcctttatcgcccccgacagagcgagttttctgagggggaagtctatggggatccagtccggcgttcaggtagacgcgaattgcgaaggggattgctatcacagcggcggtacaattatctctaacctccctttccagaatatcgactcccgagccgttgggaagtgccctcggtatgttaagcaacggagcctgctgctggctaccgggatgaaaaacgtgcctgagattcctaaaggccggggcctatttggggccatcgctggttttatagagaacggctgggaaggtctgatcgatggctggtatggttttagacatcagaatgcccagggtgaagggaccgccgccgactacaagagtacccaatctgccatcgaccagatcaccgggaagctgaaccgtctcatcgagaagacgaaccagcagttcgaactgattgataatgagttcaatgaagtggagaagcagatcggtaacgttatcaactggacgcgcgacagcataaccgaggtgtggagttataacgctgaactcttggttgccatggagaaccagcataccatcgatctcgccgatagtgagatggataagctgtatgaacgggtgaaaaggcaactgcgcgagaacgccgaggaagacggcaccggctgctttgaaatctttcacaaatgcgatgatgattgtatggcatctatcaggaacaatacctacgatcacagcaaataccgcgaggaagccatgcagaatagaatccagatagatcccgtgaagctgtccagcgggtataaggacgtcatcttgtggttcagttttggggcttcgtgttttattctgttggctatcgtcatgggcctcgtgttcatctgcgtcaagaacgggaacatgcgctgcaccatctgcata

SEQ ID NO: 631 - DNA, 1680 bp, Influenza A virus
  misc_feature (1)..(1680): Codon Optimized Sequence Encoding H7 Hemagglutinin
atgaacactcaaattttagtctttgcattaattgccattatcccaaccaacgcagacaaaatctgcctgggacatcacgccgtgtcaaacggcaccaaagtgaacacgctgaccgaacgtggggtcgaagtggtgaatgccacagagactgtcgagcgcacaaatatcccgcgcatttgttccaagggtaagcggacggtggacttaggtcagtgtggacttctaggtactattaccggacctccacagtgtgaccagttcctggagttctctgccgatctcatcattgagcgtcgcgaaggaagtgatgtctgttacccaggaaaattcgtgaatgaagaagccctccggcaaattctgcgcgagtccgggggcatcgacaaggaggcgatgggcttcacctatagtggcatccgaacaaacggcgccacctccgcatgccggaggagtggcagctccttctacgccgagatgaagtggctcttatccaacacagacaatgccgctttcccgcagatgacaaagagttacaaaaacacgcggaaaagtcccgctttgattgtgtggggtatccaccactctgtctctacagcggagcagacaaagttatacgggtctggcagtaaactggttacagtgggctcaagcaactaccaacagtctttcgtcccctcccctggcgcaagaccccaggtaaatggcctctctggaaggattgacttccactggctgatgctcaacccaaatgataccgtgacatttagcttcaacggtgcatttatcgccccagacagagctagtttccttcggggcaaatcaatggggattcagagcggagtgcaggtggatgctaattgtgaaggcgattgctaccactccggcggtactattatctcaaacctgccttttcagaatatcgatagtagagccgtgggcaagtgcccgcgttatgtgaaacagcgctctcttttgctcgctacaggaatgaaaaacgtaccagagatccccaaggggcgtggcctatttggagctatcgctggttttattgaaaacgggtgggagggcctgatagacggttggtatggcttcagacaccagaatgctcagggagagggcaccgccgccgactataaatcaacacagagtgcgatcgaccagattaccggaaaactgaatcgcctcatagagaagacaaaccaacagttcgagctcatcgacaacgaatttaacgaggtagaaaaacagatcggtaacgttatcaactggacacgggacagcatcacggaggtgtggtcttacaatgccgagcttttggtggctatggagaaccagcacacaatcgacctcgccgatagtgaaatggataaactttatgagagggtaaagcgtcagctgcgagagaatgctgaagaagatgggacaggttgctttgagatcttccacaagtgcgatgacgattgcatggcctctattagaaataacacttacgatcatagcaaatatagagaggaagctatgcagaataggatccagatagatcccgtaaagctgtcctctggatataaggacgtgatcctctggttcagttttggggcatcatgttttattctgctcgcaatcgttatgggtttagttttcatttgtgtcaaatcacggaatatgagatgtacaatctgtatt

SEQ ID NO: 632 - DNA, 1680 bp, Influenza A virus
  misc_feature (1)..(1680): Codon Optimized Sequence Encoding H7 Hemagglutinin
atgaatacacagatcctggtgttcgcactgatcgctatcatccccacaaacgctgacaaaatctgtctggggcaccacgcggtgagtaacggcactaaggtgaatacactgaccgaacgcggggtagaggtggtgaatgctacagagaccgttgagcgcactaacatccccagaatatgtagtaaaggtaagaaaaccgtcgacctgggccagtgtggcctgctgggcacaattaccggtccaccccaatgcgatcagttcttagagttctcagcagatctaattatcgagcgccgcgaggggagcgacgtctgctaccctgggaaatttgtcaacgaagaggcccttcggcaaatccttcgagagagtggcggcattgacaaggaggcaatggggtttacttatagcggaatccggaccaatggagcaacctctgcatgcaggagaagcggcagttccttctatgccgaaatgaaatggctgctgagcaatacagataacgctgccttcccacagatgaccaagagttacaagaatactaggaagtccccagccctgattgtttggggaattcaccactccgttagtaccgccgagcaaactaaactgtacggatctggaaacaaattagttacagtcggaagttctaactaccaacagtcatttgttccatctcctggtgctaggccgcaggtcaatggccaatccggccgaatagactttcactggcttatgcttaatccgaacgacacagtgacctttagcttcaatggcgccttcattgcccctgacagagcaagcttcctgagaggcaagagcatggggattcagagcggtgtccaggtggacgctaactgtgagggtgactgctatcactccggtggcactataatctctaacctaccctttcagaatatcgacagtcgggctgtgggcaagtgcccccggtatgttaaacagcgtagccttttgctggctactgggatgaaaaacgtgcccgagatacccaaggggcgcggactcttcggggccatcgcgggcttcatcgagaatggttgggaaggtctcatcgatggctggtacggattcaggcatcagaacgcacagggtgaggggacagcggctgactacaagtcgacccagagtgctatcgatcagataactggcaagctcaaccggctcatagagaaaacgaaccagcaattcgagctgattgacaacgaattcaacgaggttgagaagcagattggcaatgtgatcaactggacgagagacagcattaccgaggtgtggagttacaacgccgagctactggtagcaatggagaatcaacataccattgatttggcggattctgagatggacaagttgtacgagagggtcaagcggcagctgcgcgaaaacgcagaagaggacggcactggctgcttcgagatttttcacaaatgtgatgacgattgcatggcgtctatcaggaataacacatatgaccacagcaaataccgggaggaagcgatgcagaaccggatccaaattgatccagtcaagctgtcaagcggctacaaggatgtgatcttatggttcagtttcggagcaagttgctttattctccttgctatcgttatgggacttgtcttcatctgtgttaaaaacggtaatatgcggtgtaccatttgtatt

SEQ ID NO: 633 - DNA, 1680 bp, Influenza A virus
  misc_feature (1)..(1680): Codon Optimized Sequence Encoding H7 Hemagglutinin
atgaacacccagatcctggtatttgctctgattgccatcattcctaccaatgccgacaaaatctgtctgggccaccacgcagtttcgaatggcactaaagtgaataccctgaccgagcgcggcgtcgaggtcgtgaatgccacagagaccgtcgaacgcacaaatatacctcggatttgcagcaagggaaagcggacagtggacctcgggcagtgcggactgctcgggactataactggaccgcctcagtgcgatcaatttttggagttttccgctgatttgatcatcgagagaagagaaggaagcgacgtctgctatccaggaaagttcgtgaacgaggaggccctgaggcaaatcttgagggagagtggtggcatcgacaaagaggctatgggtttcacctactcaggtatacgcaccaacggcgcaacaagtgcttgtcggcggtcaggatcttccttctacgccgagatgaaatggttgctaagtaatacagacaatgctgcgttccctcagatgacaaagtcctataagaatacacggaagtcacctgccctgatcgtgtggggcattcaccacagcgttagcacagctgagcagaccaagttatatggcagtggtaacaaactcgtaacggtggggagttccaattaccaacagagcttcgtgccgtctcctggagctcgtccacaggtcaacggactgagtgggcgcattgacttccattggcttatgttaaaccctaatgacaccgtgacgtttagcttcaacggcgcttttatcgcccctgaccgggcctcatttctgaggggaaagagcatggggatccagtccggagtgcaggtggatgctaattgcgaaggggactgctatcacagcggaggcaccatcatttcgaatctcccattccagaacatcgactctagggctgtgggcaagtgccctcgatatgtgaaacagcggagcttgctgcttgctaccgggatgaagaacgtgccggagatccccaagggccgtggcttatttggcgctatcgcgggtttcatcgaaaatggttgggagggcctaataaacggctggtacggtttccgccaccagaacgcgcagggcgaggggaccgccgccgattacaaatccacacagagcgcaatcgatcaaataactggaaagctgaatcgcttgatcgaaaagaccaatcagcagtttgagctaatcgataacgaatttaatgaagtggaaaagcaaatcggaaacgtgatcaattggaccagagactcgataacagaggtgtggagttacaatgcagagctgctggtagccatggaaaatcagcacacgattgacctggcagattcagagatggataagctgtacgagagggtgaagaggcagctccgtgagaatgctgaagaggatggaaccgggtgtttcgagatttttcacaaatgcgacgacgattgtatggcctccatcaggaataacacatacgaccatagcaaatacagagaggaggcaatgcaaaatcggattcaaattgatcccgtgaaactttctagcgggtacaaggatgttatcttgtggttcagtttcggcgcctcctgttttattctgctggcaattgtgatgggtctggtgtttatttgtgtaaagaacgggaatatgaggtgcacaatttgcatc

SEQ ID NO: 634 - DNA, 1680 bp, Influenza A virus
  misc_feature (1)..(1680): Codon Optimized Sequence Encoding H7 Hemagglutinin
atgaacactcagatactggttttcgctttgatcgctatcatacccacaaatgccgacaagatatgcttgggtcatcacgccgtgtccaacggcactaaagtgaacacattgaccgagagaggagtagaagtggtcaatgctacagagaccgtggaacgcactaatatcccgcggatatgtagtaagggcaaaaaaaccgtggacctcggccagtgtggcctgctgggcaccattaccggcccgccacaatgtgatcagttcttggaattctctgcagaccttatcatagagcgccgggaaggatctgacgtgtgttatccaggcaagttcgttaacgaggaggcccttaggcagattttgcgtgagagcggaggcatcgataaagaagctatggggtttacatatagcggtattcgaacaaacggagccacctctgcatgcaggcggtccgggtcatcattctacgcggagatgaagtggctgctctcaaatacggacaatgcggcatttccccagatgacaaaaagttacaaaaacacaaggaaatccccagccctgatcgtgtggggaattcaccacagtgttagcaccgctgagcagaccaaactctatggctctggcaacaaattagttaccgtcggatcaagtaattaccagcagtcttttgtcccgagcccaggggctagacctcaggtgaatggacagtccggaaggatcgacttccactggctgatgcttaatccaaacgatacagttactttctcattcaatggcgccttcatcgctcccgatagagcttctttcttgcgaggcaaatcaatgggcatccagagcggggtgcaggtcgatgcaaattgtgagggtgattgctatcattcaggcggtaccatcatatccaatctccctttccaaaacattgattcccgggcagtgggaaaatgtccccgctatgtgaaacagaggtcacttctattagccacagggatgaaaaatgtgccagagattcccaaaggaaggggcctctttggcgcaatcgcaggtttcatcgagaatggttgggagggtctgatcgacggctggtacggcttcaggcaccagaacgctcagggggagggcaccgcagccgattataaaagcacccaaagtgctattgatcagatcacaggcaaactgaaccggcttatagagaagacaaatcagcagtttgagttaatagacaacgaattcaacgaggtggagaaacagattggaaacgttataaactggactcgggactctattaccgaggtttggtcttacaacgccgaactcctagtggccatggagaatcagcataccatcgatctcgctgattctgaaatggacaagctgtacgagagggttaaacggcagctgcgagagaatgcagaggaagacggaacaggctgcttcgagatcttccacaaatgcgatgacgattgtatggcttccatccgcaataacacctacgaccacagcaagtatcgggaagaagccatgcagaaccgcattcaaattgacccggtaaaactttccagcggatacaaggacgtcatcctgtggtttagtttcggtgcgagctgcttcatcttactagctatcgtgatgggcctcgtgttcatctgcgttaaaaacggcaacatgcgttgtaccatatgtatt

SEQ ID NO: 635 - DNA, 1680 bp, Influenza A virus
  misc_feature (1)..(1680): Codon Optimized Sequence Encoding H7 Hemagglutinin
atgaacacacagatcctcgttttcgctctgatagcaattatcccaacaaacgcagacaaaatctgtctggggcaccatgccgtgagtaacggcactaaggtcaatacactgacagagcgcggcgtggaggttgtcaatgctacagaaactgttgagagaacgaacatacctcggatttgcagcaagggcaaaaagaccgtcgacctgggccagtgtggcttgctcggaaccatcaccggcccaccccaatgcgaccagttccttgaattcagtgcggacctcatcatcgaaaggagagaaggaagtgatgtgtgctatcccgggaagttcgtgaacgaagaggccctgaggcagattcttcgggagtctggtggtatcgaaaaggaggccatgggattcacctacagcggcattcgcgccaacggtgcaacttctgcatgtcgccgctctgggtcttctttttacgccgaaatgaagtggctgctttctaatacagataatgcggcattcccacaaatgaccaagtcatataaaaacacgagaaagagtcccgcccttatagtgtgggggattcaccactccgtctccacagctgaacagacaaaattatacggcagtgggaataagcttgttactgtcggctccagcaattatcagcaaagcttcgtgccatccccaggggccagaccacaggtaaacgggctcagcggacgcatcgattttcattggttgatgctaaacccaaacgacaccgtaacatttagtttcaacggtgccttcatagcgcccgatcgggcatcgttcctgcggggaaaatccatgggcattcaaagcggcgtgcaggtggacgcgaattgcgaaggtgactgttatcatagcggcgggaccattataagcaatctgccttttcagaacatcgactcacgggccgtgggcaaatgccctcgttacgtgaaacaacgaagcctgctgctggcgaccggaatgaaaaatgtcccggaaatacctaaaggaagggggctcttcggggctatagccggttttatcgagaacggctgggagggcctgatcgatggatggtacgggttcaggcaccagaacgcccaaggggaaggcacggccgcggactataagtcaactcagtctgccattgaccagattactgggaagctcaatcgcctgatcgaaaagaccaaccagcaatttgagttgatcgacaatgagtttaatgaagtggaaaaacagatcgggaatgtgatcaactggaccagggactctattaccgaggtttggtcctacaacgcagagttactcgtagccatggaaaaccaacacaccattgacctcgccgatagtgagatggataaactgtatgaacgcgtcaagcggcagttgcgagaaaatgcagaagaggatggcacagggtgttttgagattttccataagtgcgacgatgactgtatggcctccatccgcaataacacctacgatcactcaaagtaccgggaagaggccatgcagaatcgaattcagattgacccagttaaactatcttcagggtacaaagatgtgattctatggtttagttttggtgcatcgtgctttatcctcctggctatcgttatgggcctcgtctttatctgtgtcaagaacgggaatatgagatgtactatttgcatc

SEQ ID NO: 636 - DNA, 1680 bp, Influenza A virus
  misc_feature (1)..(1680): Codon Optimized Sequence Encoding H7 Hemagglutinin
atgaacacccagattctagtattcgccctgattgcaataatcccaacaaatgcagataaaatctgtctgggacaccacgcggtctcaaacgggactaaggttaataccctcacggaaagaggagtggaggtggtgaacgctacggagaccgtcgagcgtacaaacataccccggatctgctcaaaaggcaagaggaccgtggatttaggacagtgcggattgttgggaacaatcaccggccctcctcagtgtgaccaatttctcgagtttagtgccgatctgattatcgaacggcgcgagggatcagacgtgtgctacccggggaaattcgtaaacgaggaggctctgcgccagattctccgggagtccggggggattgataaggaggccatggggttcacatattctggcattcggaccaatggcgccacttctgcctgcagacgctccggctcgagcttttatgccgaaatgaaatggctccttagcaacaccgataatgccgcattcccccaaatgaccaaaagttacaagaatacacgtaagtcgcctgcacttatcgtgtggggcatacaccactcagtgagcacagctgagcaaaccaagttatatggttcggggagtaagctggtgaccgtagggtcttcaaattatcagcagagtttcgtccctagtccaggcgccaggcctcaggttaacggtctgtctggacgcatcgattttcattggttgatgcttaatccgaacgatacagtgactttctcttttaatggcgccttcatcgcccccgatcgcgctagcttcctccggggtaaaagcatgggtatccagagcggcgtgcaggttgacgccaactgcgagggagactgctatcacagcggcggtaccatcatctccaaccttccctttcagaacatagactctcgggctgtcggaaaatgtcctcgatacgtgaagcagagatcactgctgcttgctactggaatgaagaacgtccccgagataccgaaagggagaggtctctttggtgctatagcagggtttattgaaaacgggtgggaaggcttgatcgacggttggtatggcttcagacatcagaatgctcagggcgagggcacagcagcagattataagtcgacacagagtgcaatcgatcagattactggcaaactgaataggcttattgagaagaccaatcagcaatttgagcttatcgacaacgagtttaacgaagttgaaaagcaaattgggaacgtcatcaactggacccgggactcaatcaccgaagtatggagctataatgccgagttgctggttgcaatggagaaccagcacactatcgatcttgcggattccgaaatggataaactttacgaaagagtgaagagacagctcagagaaaacgccgaggaggacggtacgggttgttttgagatattccacaagtgcgatgatgattgcatggctagcatcaggaacaacacctatgatcacagcaaataccgtgaggaggcaatgcagaacaggattcagattgaccctgtgaaactgtctagcggctacaaggacgtgatcttgtggttttctttcggtgccagttgttttatcttactcgccattgtcatggggctcgttttcatttgtgtaaaaaatggaaacatgaggtgtacgatttgtata

SEQ ID NO: 637 - DNA, 1680 bp, Influenza A virus
  misc_feature (1)..(1680): Codon Optimized Sequence Encoding H7 Hemagglutinin
atgaacacacaaattctcgtgtttgccctaatcgccattatcccgacaaacgcagataagatctgtctggggcaccacgcagtcagcaatggcaccaaagtgaatactcttaccgagagaggagtggaagtcgtgaatgccacggagaccgtcgagaggactaatatcccaaggatttgtagcaaaggtaagaaaacggttgacctgggccaatgcggcctgctgggcacaatcacaggtccgccccagtgcgatcagttcctggagttctcagcggatctgataattgagcggcgagaggggtcagatgtatgttacccaggtaaattcgtcaacgaggaggcactgcggcagatcctgcgagaaagtggagggatagaaaaggaagcaatgggttttacctactccggaatccgagccaatggggccacttccgcgtgtaggagaagcggaagttctttctacgctgaaatgaagtggctcctgagtaacacagataacgcggctttccctcaaatgaccaagtcatacaagaatacgcgcaagtcaccagccctcattgtgtggggaatccatcattccgtctcgactgcggaacagacaaaactctacggatccggaaacaaactggtgaccgtaggttccagtaattaccagcaaagttttgtgccctcacccggagccaggcctcaggtcaatgggttaagtgggcgcattgacttccactggttgatgctgaatcccaacgacacagtgactttctctttcaacggggctttcatagctcccgatcgggcctctttcctgcggggtaagtctatgggtattcaaagcggcgtccaggtggatgctaattgtgaaggggactgttaccactcgggaggcacaatcattagtaacctgcctttccagaatattgactcgagggcagtaggcaagtgtccccgctatgtgaagcaaaggtcactccttttggcaaccgggatgaagaatgtgcccgagataccaaagggtagagggctatttggcgcaattgcaggatttatcgagaatggttgggagggcctgattgacggctggtacgggtttcggcatcagaatgcccagggggaagggactgccgcagactacaaaagcacacagtcggctattgatcagataacgggaaaactgaacaggttgattgagaagaccaaccaacaattcgaacttatagacaacgagttcaacgaggtcgagaagcaaatcggcaacgtgatcaattggacccgggactcgatcaccgaggtgtggtcatataacgctgagctgttagtagctatggagaatcagcacacgatcgaccttgcagatagcgagatggataaactgtatgaacgggtcaagcggcagctgagagaaaatgccgaagaggacggtacgggctgctttgaaatttttcataagtgcgacgatgactgcatggccagtattagaaacaacacctacgaccattccaaatatcgggaagaagcgatgcagaacagaattcagatagatccagttaagctgtcctctggatataaggatgtgatactgtggttttcttttggcgccagttgctttatattgctcgcaattgtgatggggctggtgttcatttgcgtcaaaaacgggaacatgaggtgcaccatttgcatt

SEQ ID NO: 638 - DNA, 1680 bp, Influenza A virus
  misc_feature (1)..(1680): Codon Optimized Sequence Encoding H7 Hemagglutinin
atgaatacacagattctggtatttgctctgatcgcgattattccgacgaatgcagataagatctgtttaggccaccacgctgttagcaatgggacgaaagtgaatactctaacagaacgtggggtggaagtcgtcaatgctacggagactgtcgagcgcaccaatattccaaggatctgttccaagggtaagaagactgtggacctcgggcaatgcggtctcctaggcaccattaccggtcctcctcagtgcgatcagtttctggaattctctgcagatcttattatagagcggcgcgagggcagtgatgtgtgctacccaggtaagttcgtcaatgaagaggctctgcgtcaaattttgagagagtcaggcggcattgataaggaggccatgggctttacctacagcggaatccgcaccaacggagcaaccagcgcctgtcggagaagcggtagcagtttctacgccgaaatgaaatggctactttctaataccgataatgctgcgtttccacagatgacaaagagttacaagaacacccgtaagagtcctgccctcatcgtgtgggggatccatcacagtgtgtcaaccgcagagcaaaccaaattgtatggttccggaaacaaactggttaccgtgggctctagcaattaccagcagagtttcgttccgtcccccggcgctagaccccaagtcaatggtcagagcggaagaatcgatttccactggctgatgctgaatcccaatgacactgtgactttctcctttaatggggccttcattgctcccgaccgcgcttcattcttgcgcggcaaatccatgggaatacagagcggtgtgcaggtggatgccaattgcgaaggtgattgttatcacagtggaggaactattatctctaatctgccgtttcagaacattgacagcagagccgttggcaagtgtccacgatacgtcaaacagcggtccctcctgttggccacaggcatgaagaacgtgcctgagatccctaaggggcgcggactgtttggagccatcgcgggatttattgagaacggatgggaaggcttgatagatggctggtatggctttaggcaccagaatgcacagggggagggcaccgccgctgattacaagagcacgcagtctgcgatcgaccaaataaccggtaagttaaatcgcctgatcgagaaaaccaatcagcagttcgagctgatcgacaacgagtttaatgaagtcgaaaaacagatcggcaacgtgatcaattggaccagggacagtatcacagaggtatggagctacaatgccgagctgctggtggccatggagaatcagcatacaattgacctagctgatagtgagatggacaaactgtatgagagggtcaagagacaattgcgggaaaacgcggaggaagatgggacaggctgcttcgagatcttccataagtgcgacgacgactgtatggccagtatcagaaataacacgtacgaccactcgaagtatagggaggaggcaatgcagaacagaattcagatcgaccctgtgaagcttagtagtggatacaaggacgtgattctctggttctctttcggggcctcatgtttcattttgctcgctatagttatgggcctagtgttcatctgcgtgaagaatgggaatatgcggtgcacgatttgcatc

SEQ ID NO: 639 - DNA, 1680 bp, Influenza A virus
  misc_feature (1)..(1680): Codon Optimized Sequence Encoding H7 Hemagglutinin
atgaatactcagatcttagtgttcgcattgatcgccatcatcccaaccaacgccgataaaatttgccttggacatcatgctgtgagcaacggcacaaaggtcaatacacttacagaaagaggggtggaagtggtgaacgccacagaaaccgtggaacggacgaacattccccgaatttgttctaagggaaagagaacagtagacctcggacagtgtggcctcctgggcaccataaccggccctccacagtgtgaccagtttctggaattcagcgcggatctgattattgagaggcgggagggctccgatgtctgctaccctggcaagtttgtgaacgaggaggccctgaggcagatcctacgggagtccggagggatcgataaagaggcaatgggttttacctacagcggcatccggaccaatggagccacttctgcatgccggcgctccgggagttcattttatgctgagatgaaatggttactttctaacaccgataacgcagccttcccacagatcaccaagagctataaaaatacgcgaaaatctccagccctcatagtctggggtatccatcactctgttagcacagcggagcagaccaagttatacgggtcaggaaataaacttgtgacagtgggctcctctaactatcagcagtcttttgtgcccagccctggggccaggccccaagtcaatggcctttctggtaggattgatttccactggttgatgttgaaccccaatgataccgtcacattcagctttaatggtgcttttatcgcccctgaccgagctagtttcctaagaggaaaatctatgggtatccagtctggcgttcaggtggacgccaattgtgagggcgactgttatcattccgggggaaccatcatctctaaccttcccttccaaaatatcgactccagggcagttggcaaatgtccacggtatgtgaagcagagatcactcctgttagcgactgggatgaaaaacgtgccagaaatccctaaaggtcgtggattgttcggagcgatcgcgggatttatcgaaaacgggtgggagggtcttatagacggctggtatgggtttagacaccagaacgcacagggtgagggcaccgcggcagactacaaatctacacaatctgcaatagatcagatcaccggcaagctgaaccgacttattgaaaagaccaatcagcagtttgagttaatcgataacgaattcaacgaggtggagaagcaaatagggaatgttattaactggacacgggactcaatcacagaagtatggtcgtataatgcagagctgctagtcgcaatggagaatcagcatacgattgacctcgccgacagtgagatggacaagttgtatgaaagggtcaaaagacagctccgggaaaatgccgaggaagacggcacaggctgttttgaaatattccataagtgcgacgatgactgcatggcaagtattaggaacaacacgtatgaccattcaaagtacagggaggaggccatgcagaaccgcatccagattgatccagttaagcttagcagtggctataaggatgtcatcctgtggtttagttttggcgcctcctgttttatcctgctggccatcgttatggggcttgtgttcatatgcgtgaagaatggcaatatgcgctgcaccatttgtatt

SEQ ID NO: 640 - DNA, 1680 bp, Influenza A virus
  misc_feature (1)..(1680): Codon Optimized Sequence Encoding H7 Hemagglutinin
atgaatacacaaattctggtattcgccctcatagctataattcccaccaacgccgataagatttgtttaggtcaccacgccgtgtcaaacgggacaaaggttaatacacttacagagcggggcgtggaagtcgtgaacgctactgagacagtcgaaaggactaacatccccagaatttgtagcaaaggaaaaaagaccgtggatttggggcagtgtggcttactagggacaatcaccggtccaccccagtgtgaccagttcctcgagttctcagcggacctaattatcgagcgtcgagagggcagcgatgtgtgctatcccgggaaattcgtgaatgaggaggccttacggcagatcttgcgtgaaagtgggggcatagataaagaggcgatggggttcacgtattctggcattcgcaccaacggagctacctcagcctgtcgtcgttcaggatccagcttctacgcagaaatgaagtggttactctctaacacagataacgcagccttcccgcaaatgacgaagagctacaaaaacactcgcaaatcccccgccctcatcgtctggggtattcaccacagcgttagcaccgctgaacagactaaattatacggcagcggaaataagcttgtcaccgtcgggagctccaactatcagcagagctttgtcccatctcctggggcccggccccaggtgaacggacagtccgggcgcattgatttccactggttgatgctgaacccaaacgacactgttacgttcagctttaacggcgccttcattgcacctgaccgagctagctttttgcggggcaaatcgatgggaatacagtcaggggtccaggtagacgccaactgcgaaggcgattgctaccattccggcgggacaatcatctccaacctgcccttccagaacattgacagccgggcagtcgggaagtgtcccagatatgtgaaacaacgctctctgctgcttgcgaccggcatgaaaaacgttccagaaatcccgaaggggcgaggtttgtttggcgctatagctgggttcattgagaacggctgggaaggcctcatcgacggctggtatggatttaggcatcaaaatgcacagggcgaaggtaccgctgccgactataagtcaactcagagcgcaatagaccaaattaccggaaagctcaatcgcctgattgagaaaaccaatcagcagtttgaactgatagacaacgaatttaatgaagtggagaagcagatcgggaatgtgatcaactggactcgtgacagtattactgaggtatggagttataacgctgaacttctggtggctatggagaaccaacacactattgatctcgccgactccgagatggataaactctacgaaagagttaaaagacagcttagggaaaacgccgaggaggatggtactggatgtttcgagatctttcataaatgcgatgacgactgcatggctagcatccggaataacacctacgatcattctaagtatcgtgaagaagccatgcaaaatcgtattcagattgatccggtaaaattgagctcaggctataaggacgtcatactgtggttctccttcggcgcttcctgctttatcttattagcaattgtgatgggattagttttcatctgcgtgaaaaacggaaacatgcgctgtaccatttgcata

SEQ ID NO: 641 - DNA, 1680 bp, Influenza A virus
  misc_feature (1)..(1680): Codon Optimized Sequence Encoding H7 Hemagglutinin
atgaacactcaaattttagtgttcgccttgatagcaatcatccccacaaatgcggataaaatctgtctcggccatcatgccgtgtctaatggtaccaaagtaaatacccttaccgagcgtggggttgaggtcgttaatgccaccgagactgtggagagaaccaatatcccccgcatctgttccaagggaaaaaagaccgttgacctcggtcagtgtggtctgcttggtacaataaccggaccgccccagtgcgaccaattcctggaattcagtgcggatctcataatcgaaaggcgagaaggctccgatgtttgttaccccggaaagttcgtcaacgaggaggccctgcgacagatattgcgggaaagcggaggcatcgataaggaggctatgggcttcacatatagtggaatccgcacgaatggggccacctcagcctgtcggcgcagcgggtctagtttttatgctgaaatgaagtggcttctttcgaatactgacaatgctgccttcccccagatgaccaagagttataaaaataccagaaagagccctgccctgatagtctggggaatccatcacagcgtaagcactgccgaacagactaagctctatggcagcgggaataagctcgtgaccgtgggcagttccaattaccagcagagctttgtgccatccccgggggcccgtccacaggttaacgggcaatctggccgaattgattttcattggctgatgctgaatccaaacgatactgtgactttctcttttaacggagccttcattgcacccgatcgggcaagcttcctgcggggaaaatctatgggaattcagagtggggtgcaggtggacgcaaactgtgaaggcgattgctaccactctggcgggacaatcattagcaatctgcctttccagaacatagacagccgcgcagttggaaaatgcccgcgttatgtcaagcaaaggagtttactgctcgctacaggcatgaagaatgttccggagatcccgaagggaagaggtttgttcggcgccatagcaggattcattgaaaatggctgggaagggttaatcgacgggtggtatggttttcgacaccagaacgcacaaggggaggggacagcagcagattacaagagcacacagtcagcaattgaccagattactggaaagctaaaccggctcatcgagaagaccaaccagcagttcgaattgattgacaacgaatttaatgaggtggaaaaacagatcggtaacgtcataaactggactagagattccattactgaggtctggtcatataatgccgaactgctcgtggcgatggagaatcagcataccatagatctcgccgactccgagatggacaaactttatgaacgggtgaagcgccagctgcgggaaaatgccgaagaggacggtacagggtgtttcgagattttccataaatgtgatgacgactgcatggcaagcatacgcaataacacatatgatcactctaagtatagggaagaggccatgcagaaccgaattcaaatcgacccagtaaagctttctagcggctataaagatgtgattctgtggtttagcttcggggcctcttgttttatcctgttagccatcgtcatggggctagttttcatctgcgtgaaaaatggcaacatgcgttgcactatatgcatc

SEQ ID NO: 642 - DNA, 1680 bp, Influenza A virus
  misc_feature (1)..(1680): Codon Optimized Sequence Encoding H7 Hemagglutinin
atgaatacgcagatcctcgtgttcgcactgatagcgatcatcccgacaaatgctgacaaaatctgtttgggccatcatgccgttagcaatggtaccaaagtgaacactctcactgagcgcggcgtggaagtggtgaacgccactgaaacagtagaaagaacaaacattcccagaatctgcagtaagggtaagaaaactgtcgacttgggccagtgtggcctattaggaacaatcaccggacctccccaatgcgatcagttcctagaatttagcgctgatctgataattgaaagaagagaaggttcggatgtctgttacccgggtaaattcgtgaacgaagaagccttaagacagattctcagagaaagtggcggaattgataaagaagccatggggttcacttattctggcatacggacaaatggggccactagcgcatgtagacgatcaggcagctctttctacgccgagatgaagtggctgttatccaacacagacaatgcagcctttcctcagatgaccaaatcctacaaaaatacaaggaagagccccgcactaatcgtatggggcatccatcactctgtgtcgacggcagaacaaaccaagctctatggtagtgggaacaagttggtgacggtggggtcctctaattaccagcagtcgttcgtgccctctccaggtgcccggccccaggtgaatggtcagtccggccgaatcgactttcactggcttatgctgaatcccaatgataccgtaacatttagctttaatggagctttcattgctcctgaccgtgccagcttcttgagaggaaaatctatgggcatacagtctggtgtccaggtggatgctaactgcgaaggtgactgttaccactcaggaggtactataattagcaatctccccttccagaacatcgacagccgcgctgtaggaaagtgccctcgctacgtgaagcaacgatcattactgctggccactggcatgaagaacgtacccgagatcccaaagggaaggggtttgtttggcgccattgcgggctttattgagaacggatgggagggtctgatcgatggatggtatggattccgtcatcagaatgcccagggcgaggggaccgctgctgattacaaatccacacaatctgcaatagatcaaatcacaggaaaactgaaccggcttattgaaaaaaccaatcagcagttcgagttgatcgacaatgagttcaatgaagtggaaaagcagatcggcaacgtcatcaactggactcgggactctatcacagaggtctggtcctacaatgcagagttactagttgccatggagaaccagcacacgattgatttggccgatagcgagatggataaactctacgagcgtgtgaagaggcagctgcgcgaaaatgccgaagaggatggaacaggttgcttcgagatcttccacaaatgcgatgacgactgcatggcctccatcaggaataatacttatgatcacagcaagtaccgggaggaagccatgcaaaacagaattcagattgatcccgtaaagttaagctccggctacaaagatgtgattctgtggttctctttcggagcttcatgcttcatcctcctcgctatagtgatgggtctcgtattcatttgcgttaagaacggcaatatgagatgcacaatctgtatt

SEQ ID NO: 643 - DNA, 1680 bp, Influenza A virus
  misc_feature (1)..(1680): Codon Optimized Sequence Encoding H7 Hemagglutinin
atgaatactcaaatcctggtgttcgcactcattgccatcataccaaccaacgcagacaagatatgcttgggccatcacgccgtgtctaatggtacgaaagtgaatactctgactgagcgcggggtcgaagtagtaaacgcgactgaaacagtggaacgaactaatattcccagaatttgcagtaaagggaaaaagaccgtcgatctcggccaatgcggactgctggggacaatcacagggccaccgcaatgcgatcagttcctggagtttagcgcggatctcatcatcgagcgaagagaagggtccgacgtctgttacccgggtaaatttgtgaatgaagaggccctgcgtcagattctgcgggaaagcggcggaattgacaaggaggcaatggggttcacgtacagtggtatcagaaccaacggagctacaagcgcatgcagacggtccgggtcctcgttttacgcggagatgaagtggctgttatccaacactgacaacgctgctttcccacagatgaccaaaagctataagaacacaagaaaaagtccagccctgattgtgtgggggatccaccattcggtatcaactgctgagcaaacaaagttatatggaagtggaaacaagcttgtcaccgtaggttcatccaactatcaacagagtttcgtgccctcccccggagcccgcccccaggtgaatggacagtcgggaagaatagactttcattggttgatgctgaatcccaatgacaccgtgaccttcagctttaatggggccttcattgccccggacagggctagctttctccgaggaaagagcatgggcattcaatctggagttcaagtggatgccaactgtgagggcgattgctaccatagcggagggacaatcatcagcaacctccccttccaaaacattgatagtcgtgctgtaggaaaatgccctcggtacgttaaacaaagatcgctgctactggctacaggaatgaagaacgtgcccgagatcccaaaaggacgaggcctatttggggccatcgcgggttttatcgaaaatggatgggagggcctcatcgacgggtggtatggctttcgtcatcagaatgctcaaggcgaaggaacagccgctgattacaaatcaacccaatctgccatcgaccagatcaccggaaagctcaaccgcctgattgaaaagactaatcagcagttcgagctgatcgacaatgagttcaatgaagtggaaaagcagattggtaacgtgattaactggactagagattccattaccgaagtgtggtcttataacgccgagctactggtcgccatggagaaccagcataccattgatttagctgattctgagatggacaagctgtacgaaagggtgaaacggcagctccgagaaaatgccgaagaagacggaaccgggtgtttcgagatcttccacaagtgcgacgacgattgcatggctagcattagaaacaacacttatgaccacagcaagtatcgcgaagaggcgatgcagaatcgaatccagatcgatcctgtcaagctgagcagcgggtacaaggacgtgatcttatggttttccttcggggctagctgttttatcctgctggctatcgtgatgggtctggtttttatatgtgttaaaaacggcaacatgcggtgcacaatctgcatt

SEQ ID NO: 644 - DNA, 1680 bp, Influenza A virus
  misc_feature (1)..(1680): Codon Optimized Sequence Encoding H7 Hemagglutinin
atgaatacccagattttagtgtttgcacttatcgctatcataccaactaatgctgacaagatctgcctgggccaccatgcagtgagcaacgggaccaaagtgaacaccctaaccgagcggggcgtggaggtggtaaatgccactgaaaccgtcgaaaggacgaacattccgcggatttgcagtaaaggcaaacgaaccgtggacctgggccagtgtggcctcctggggaccatcacgggaccaccccaatgtgaccagttcctggagttctccgctgaccttatcatcgaaaggcgagaagggtctgatgtctgttaccctggaaaattcgtaaacgaggaggctctccgacaaattctgcgggaatccggcggcatcgacaaggaggcgatgggttttacctattccgggatacgcactaacggagctacatcagcatgtaggcgctctgggtctagtttctatgccgaaatgaaatggttgctgtcaaacactgacaacgctgctttccctcagatgactaagtcctataagaatacccggaagtccccagcactaatagtctgggggattcaccactccgtatctactgcggagcagacgaaactttacgggagcgggaacaaactggtcactgttgggtcatcaaattatcagcaatcattcgtaccctctcccggcgctcggccccaggtcaatggcctgtccggcagaattgacttccactggcttatgctaaatcctaacgacaccgtgaccttctccttcaacggcgccttcatcgcgcctgaccgagctagctttctgcgtgggaaaagtatgggaattcagagcggtgtgcaggtggatgcaaattgtgaaggcgactgctatcatagcgggggtaccattatctctaatctgcctttccagaacatcgacagtagagccgtgggcaaatgccccagatatgtgaaacaacgtagccttctgctggcaacaggaatgaaaaatgtgcccgagattcccaaagggcgtgggctgtttggggccatcgccggcttcatcgaaaacggttgggagggattaatcgacgggtggtatggcttcaggcaccaaaacgctcaaggggagggcacggcggcggattacaaatctacccagtccgccattgatcaaattactggcaaattaaacagaatcatcgaaaagactaaccagcagttcgaactgattgataatgagttcaacgaggttgagaagcaaatcggtaacgttatcaactggacgcgtgacagtatcaccgaggtctggtcatataatgctgagctgctcgtggctatggaaaaccagcacactatcgatctggcggactccgagatggacaagttgtatgaacgggtgaaaagacagcttcgggagaacgccgaggaggacgggaccggatgcttcgagatctttcacaagtgcgatgatgattgcatggcttcaattcgcaataatacatatgaccattctaagtacagggaggaggctatgcagaaccggatccagatagatcccgtcaaacttagtagcgggtacaaggatgtcatcctgtggttttccttcggggcctcatgctttattcttctggccatcgtgatgggactcgtgttcatctgcgttaagaatggcaacatgcgatgtacaatctgcatc

SEQ ID NO: 645 - DNA, 1680 bp, Influenza A virus
  misc_feature (1)..(1680): Codon Optimized Sequence Encoding H7 Hemagglutinin
atgaacacccagattctcgtgttcgctttgatcgcgattatacctactaacgcagataaaatatgtctgggtcatcacgctgtcagtaacgggacaaaggtgaacacgttgaccgagaggggcgtcgaggtggttaacgccactgaaacagtggaacggaccaatataccaaggatctgtagcaagggtaagaagactgtcgacctcggtcagtgtgggttgcttgggaccatcaccgggcctccacagtgtgatcagtttctggagttctcggctgacctgataatcgagagacgggagggcagtgacgtgtgctacccagggaagtttgtgaacgaagaagcattgcgacagattcttcgggaatcaggtggaatcgacaaggaggccatgggatttacatactctgggatcaggaccaacggtgctacctccgcttgtaggagaagtggatcaagcttttatgctgaaatgaaatggcttctgtccaatacggacaacgcagctttccctcagatgacaaagtcctacaaaaacacaagaaagtcacccgctctgattgtttggggaatccaccactcagtgtccacggcggagcagacgaaactctatggctctgggaataagctggtgacagtcgggagctcaaattatcagcaatccttcgttccatcccccggcgcccgacctcaggtcaacggccaatcgggcaggattgacttccattggctaatgctcaatcccaatgacaccgtcacattctcttttaatggtgccttcatcgccccagatcgagcctcttttctcagaggtaagtcgatgggaatacagtcaggggttcaggtggacgctaattgcgaaggggactgctatcattctgggggcacaattatttcaaatctgccattccagaacattgactctcgagccgtcggaaaatgccctcgatatgtaaagcagcgaagtctgctgctggcaaccggcatgaaaaacgtacccgagatcccaaagggcagagggcttttcggtgcgatcgccgggtttatcgaaaatggctgggagggcctgatcgatgggtggtacggttttcggcaccagaacgctcagggtgagggcactgcagcggattataagagtacccagtcagccattgaccagatcacaggtaagttgaaccgcctcattgaaaagaccaaccagcagtttgagctgatcgataatgagtttaatgaggtggagaagcagatcgggaatgttattaattggacgcgcgattcaatcacagaggtatggtcatacaacgctgagctgctggtggcaatggagaatcaacacacgatcgacctcgctgactcagaaatggataaactgtacgaaagggtcaaaaggcagctgcgcgagaacgccgaagaagacggaactggttgtttcgaaattttccacaagtgtgacgacgactgtatggcatccatcagaaacaacacatacgaccatagcaaataccgggaggaggcaatgcagaatcgaatccagattgatcccgtgaagttgtctagcggatacaaagatgtgatcttatggttttcattcggggctagctgtttcatcctcctggccatagttatggggctcgttttcatctgcgtaaagaatgggaatatgagatgtactatctgcatt

SEQ ID NO: 646 - DNA, 1680 bp, Influenza A virus
  misc_feature (1)..(1680): Codon Optimized Sequence Encoding H7 Hemagglutinin
atgaatacgcagattctggtgttcgctctcatcgctattattcctaccaatgccgataagatctgtctggggcaccacgccgtcagcaacggcactaaagtgaacaccttgacagaaaggggggtggaagtggtgaacgcaacggaaacagtggagaggacaaacataccgcggatttgctcgaaaggaaaacggactgtagacctgggccaatgcggcctgctcggaaccatcaccgggccaccccaatgtgaccagttcctagaattttccgccgaccttataattgagcggagggagggatccgatgtgtgttatcctggcaagttcgtgaacgaggaggccctgcggcagatattgcgtgaatctgggggcatcgacaaggaggcgatgggattcacatactccggcatccgcaccaacggcgcgaccagcgcatgccgtcgctccgggtcctcattctacgctgaaatgaaatggctcctctcaaatactgataatgctgcttttcctcaaatgaccaaaagttacaaaaacaccaggaaaagcccagctctgattgtctggggcattcaccattccgtatctacggcagaacagactaaactatatggcagtggcagcaagctcgtgaccgtcggctcctccaactatcagcaatctttcgttccatcaccaggcgcccggccccaggtcaatgggctctccggccgtatcgatttccactggctgatgctcaatcctaacgacaccgttaccttttcttttaacggcgcctttattgctccagacagagcgtctttcctgcggggtaaaagcatgggcattcagtctggtgtccaagtggacgcaaactgtgaaggggattgctatcatagtggcggcactatcattagtaacctgcctttccagaacattgattcgcgggcagttggcaaatgccccaggtatgtcaaacagagatcactcttgttagctaccggaatgaagaacgtaccggagattcctaagggtaggggactgttcggggctattgccgggttcatcgagaatgggtgggaaggtctcatcgacgggtggtatggctttcgtcatcagaacgcccagggcgaaggtacagcagccgattataagtctacccagtccgctatcgaccaaataaccgggaagttgaaccggttaatcgagaaaaccaaccaacagttcgaattgatcgacaatgaatttaatgaggtggaaaaacaaatagggaacgtgataaactggacaagggactccattacagaagtctggagctataacgccgaactgctggtagctatggagaatcagcataccattgacctggcagacagtgagatggacaaactttacgaacgggttaaaagacagttgcgagagaatgccgaagaagatggaactggctgctttgagatttttcacaaatgcgatgatgactgtatggccagcattagaaacaacacatacgaccacagtaagtacagggaagaagccatgcaaaaccggatccagattgaccccgtcaagctgagctcgggttataaggatgtaatcttatggttcagttttggcgcctcctgcttcattcttctagcaatcgtgatgggattggtcttcatttgcgtgaaaaatggcaatatgaggtgcaccatctgcatt

SEQ ID NO: 647 - DNA, 1680 bp, Influenza A virus
  misc_feature (1)..(1680): Codon Optimized Sequence Encoding H7 Hemagglutinin
atgaatacacagatcctagtcttcgccttaattgcaataatacctaccaacgcagacaaaatttgtcttgggcaccacgccgtgtccaacgggaccaaagttaataccctcaccgaacgtggggtggaggtggtaaacgctacggagacagtagaaaggaccaacatacctcgcatctgttccaaagggaaaagaaccgtcgacctggggcagtgcgggctgctaggaactattactggcccaccacagtgcgatcagtttctggaatttagtgctgatctgatcatcgaaaggcgtgagggtagcgatgtctgttatcccgggaagttcgtgaatgaagaggcgctgagacaaattctgagagaaagcggggggatcgataaggaagcaatggggtttacttattctggcattagaaccaatggggccacatccgcctgccgcaggtctggaagctccttttatgctgaaatgaaatggctgctgagtaatactgacaacgccgcttttcctcagatgacaaaatcttataaaaacacgagaaaatctcctgccctgattgtgtggggcattcaccattcggtttcaacagcggagcaaactaaactatatggaagcggcagcaagctggtcacagtgggaagctctaactaccaacagtcttttgttcccagtcccggcgcccgacctcaggtcaacggactgagtggcagaattgatttccactggctgatgcttaatccgaacgataccgtcaccttttctttcaatggtgcttttattgcccctgacagggcaagcttcttgcgcgggaagtctatgggaatccaatccggcgtacaagtggacgcaaactgtgaaggggactgttatcactccggaggcacaattattagtaacttgcctttccagaatatcgattccagagccgtgggtaaatgccctcgatacgtaaaacagcgctctctgcttctggctaccggaatgaagaatgtgcctgagatccctaagggcagaggcctgttcggggccatcgctggttttattgagaatgggtgggaaggcttaatagacgggtggtacggttttcgtcaccaaaatgcacagggcgaaggcacagcagccgactacaaaagtacgcaaagcgccatagatcagataacaggaaaacttaatcgcctgatcgaaaaaacgaaccaacagttcgaactgattgacaatgaatttaacgaagtcgaaaagcagataggcaatgtcatcaattggacgagagacagtattacagaagtttggagctataatgcagagctgttagtggcgatggaaaatcagcacaccattgatttggcggacagcgaaatggacaagctgtacgaacgagtgaagcgacagctacgcgagaatgcagaagaagatgggactggctgcttcgaaatctttcacaagtgcgacgacgattgcatggccagcattcgcaataacacatacgatcactccaagtatcgagaggaggcgatgcaaaaccgaatccaaattgaccctgtgaaattatctagtgggtataaagacgtgatactgtggttttcattcggagcttcatgtttcattctgttggcaattgtcatgggactggtgtttatatgtgtaaaaagcagaaatatgcgatgcaccatttgcatc

SEQ ID NO: 648 - DNA, 1680 bp, Influenza A virus
  misc_feature (1)..(1680): Codon Optimized Sequence Encoding H7 Hemagglutinin
atgaatacccagatcctggtattcgcattaattgctatcattcctacaaatgctgacaaaatctgtctcggccatcacgccgtgagtaatggaactaaagtgaatactctcactgagcgcggggtagaggtagtgaatgccactgagaccgtcgagcgaactaacatcccccgcatctgtagcaaaggcaagaagacggtggacttaggacagtgtggcctcctggggaccatcacaggacctcctcagtgcgaccagtttctggaatttagtgctgaccttatcattgaacggcgcgagggcagcgatgtctgctaccctggcaagtttgtcaatgaggaagccttacgacagatcctcagagaatcaggggggattgacaaggaggcaatggggttcacctatagcggaatccggactaatggcgcaacaagtgcatgtagacggagtgggagtagtttttacgccgaaatgaagtggctgttaagcaacacggacaacgctgcttttccacagatgactaagtcttacaaaaacaccaggaagtcacctgctctgatcgtgtggggaattcaccatagcgtgagcacagctgagcagaccaagctttacggaagtggcaacaaactcgtgacagtgggcagctccaactaccagcagtctttcgtgccctcccccggcgcaagacctcaggtcaacgggcagtcggggcgtattgacttccactggctcatgctgaaccccaatgatactgtgaccttttcgttcaatggggcgtttatcgcccctgatcgggcaagcttcctgaggggtaaatcaatgggaatacagtccggcgtccaggtggatgccaactgtgaaggcgactgctatcattccgggggtaccattatcagcaaccttccctttcagaacattgattctcgggctgtgggaaaatgtcccaggtacgtcaagcagcggtcactcctgctggcaactgggatgaagaacgtccctgaaatcccgaaagggcgtgggctgtttggtgctatcgctggattcatcgaaaacggctgggaagggcttattgatggttggtacgggtttcgccaccagaacgcgcagggcgagggcaccgctgcagactataaatctactcagtctgcaattgaccagatcaccggcaaactgaaccgcctgattgagaagaccaaccaacagtttgagctcatagataacgaatttaacgaggtggaaaagcaaatcggaaacgttatcaactggactagggactctatcactgaagtgtggtcctacaatgcagagctgctcgttgccatggaaaaccagcacaccattgacctagctgactccgagatggataaactgtatgagcgggtaaaacggcagctgagagagaacgccgaagaggacgggacaggatgttttgagatatttcacaaatgcgacgacgactgtatggcaagcatccggaacaacacctacgatcattctaaatatcgggaggaagccatgcagaatcgcattcagattgatcccgtcaaactgagttctggctataaggacgtaattctgtggttctccttcggagctagttgcttcattctgcttgcaatagtaatgggactcgtttttatttgtgtcaagaacggcaacatgaggtgtaccatttgcata

SEQ ID NO: 649 - DNA, 1680 bp, Influenza A virus
  misc_feature (1)..(1680): Codon Optimized Sequence Encoding H7 Hemagglutinin
atgaatacacagattctggtctttgctctcatcgctataatcccgaccaacgctgacaaaatctgtctgggtcaccacgccgtatctaatggaactaaggtgaatacattgaccgagcgcggcgttgaggtcgttaatgctacagaaactgttgagcggacaaatatcccccggatatgctcaaagggaaaaaagactgtcgacttaggacaatgcgggttactaggcacaataacagggccgccccagtgcgaccagtttctcgagttcagtgccgatctgattatcgaacgccgggagggaagcgacgtctgttatcccggcaaattcgtgaatgaagaggccctccgccagatcctgagagaatccggaggcatcgacaaggaggccatgggattcacttactctggaatcaggaccaacggggctacctccgcgtgccgacggtccgggtcctctttctacgcagagatgaagtggctactatctaataccgataacgcagctttcccccaaatgacaaaatcatataagaatacaaggaaatctccggcattgatcgtctggggcattcatcactctgtcagtaccgctgaacaaacaaagctgtatggcagcgggaacaagctggttacagtggggtctagtaactatcaacagtccttcgtgccatctccgggagcgcggccacaggtgaatgggcagtctggccggattgactttcactggttaatgttaaatccaaacgacacggtgactttttcatttaacggtgcctttattgctcctgacagagcctcatttctcagaggcaaatcaatgggtatccaatcaggcgtgcaggtggacgctaactgcgagggcgattgctaccactctgggggcacaatcatatccaacctgcccttccagaatattgactcaagagccgtcgggaaatgtccacggtacgtgaaacagaggagtctactgctagctacaggaatgaagaatgtgcccgagattccgaaagggagagggttgtttggagccatcgcaggattcattgaaaatggatgggaaggtctcatagatggttggtatggctttcgacaccaaaacgcgcagggcgaggggactgcagctgactacaaaagtacgcaatctgccattgatcagattacaggaaagctcaaccgactgatcgaaaaaacaaatcagcagtttgagctcatagacaatgagttcaatgaagtggaaaagcagatcggcaacgttatcaactggacgcgcgactcaatcacagaagtgtggtcttacaatgcagaattgcttgtcgccatggagaatcagcacactatcgacctggccgacagcgaaatggataagctctacgagagggtcaagcgccaacttcgagagaatgctgaggaggacggaaccggttgctttgagatatttcacaagtgtgatgacgattgcatggcatcaatcagaaataatacttacgaccattcgaaatacagggaagaggcaatgcagaacagaattcagatcgaccctgtgaagctttctagtgggtataaagacgtgatcctctggttcagttttggagcatcttgtttcattctgctagccattgttatgggacttgtcttcatttgcgtgaagaacgggaatatgcgttgtacgatctgcatt

SEQ ID NO: 650 - DNA, 1680 bp, Influenza A virus
  misc_feature (1)..(1680): Codon Optimized Sequence Encoding H7 Hemagglutinin
atgaacactcagatactcgtcttcgccctcatagccatcattcccacgaatgccgacaaaatctgtctgggtcaccacgcggtaagtaacgggactaaggtcaacacactgacagaaagaggcgtcgaagtcgtgaacgccacagagacggtggagaggacaaacatacccagaatttgctcgaagggcaagaagaccgtagatctgggccagtgcgggctgttgggcaccatcacaggccccccccagtgcgatcagttcctggaattctctgccgaccttatcattgaaaggagagaggggagcgatgtttgttaccccgggaagttcgttaacgaggaggcccttagacagatccttcgggaatccggtgggattgacaaggaagccatgggattcacctactctggtatacggactaacggagccacctcagcctgcagaagaagcggtagttctttttatgccgaaatgaaatggctgttgtcaaacaccgacaatgctgccttcccacagatgaccaaatcatacaagaatacccgcaagtctcccgccctgattgtgtggggcatccatcactcggtgtccaccgccgaacagactaagctctacggctcagggaataagctggtgactgttggcagctcaaactaccagcagtccttcgtgcctagccctggtgcccgtccccaggtgaacggccagagcggtcggattgacttccattggcttatgttgaacccaaacgataccgtgaccttctccttcaatggtgcctttatagcacccgatcgggcgtcctttctgcgcggtaaatctatggggattcaaagcggcgtccaggtggatgctaattgtgaaggagattgctatcacagcgggggaactataatttctaacctgccatttcaaaatattgatagccgggcagtgggaaagtgtcctcgctatgttaaacaaagatctcttttgctggctaccggaatgaagaacgtgccagagatccccaaaggaaggggactgttcggagcaatcgccgggtttattgaaaatggatgggagggcctcattgacggttggtacgggttccgccaccagaacgctcaaggagaggggacggcagcggattataagagcactcagtccgcaatcgaccagatcacaggaaagctgaatcgcctcattgagaaaacaaaccagcagttcgagttgattgataacgaattcaacgaggtggaaaaacagatcggcaatgtgataaactggacccgcgactccattactgaggtctggtcttacaacgcagaactgcttgtcgcaatggagaatcaacacaccatagatctcgctgattctgaaatggataagctgtacgaaagggtgaaaagacagctgagagagaatgctgaagaagatggcaccggttgcttcgagatctttcacaaatgtgacgatgactgcatggcctccattaggaataacacatatgatcattccaagtacagggaagaggccatgcagaaccggattcagattgatccggttaagctgagttccgggtacaaagatgtgatactatggttttctttcggcgcgagttgcttcattttgcttgccatagtgatgggtttagttttcatctgcgtgaagaacggaaacatgcgctgcactatttgcata

SEQ ID NO: 651 - DNA, 1680 bp, Influenza A virus
  misc_feature (1)..(1680): Codon Optimized Sequence Encoding H7 Hemagglutinin
atgaatacccagattcttgtttttgctcttatagccataatacccacgaacgcagacaaaatctgcttgggccaccacgcagtatctaacggcaccaaggtgaatactctcaccgaacgtggggtggaggtcgtgaatgctacagaaacagtggagcgcacaaacattcctcgtatttgttcaaaagggaagaagacagtggatctgggccagtgcggcctattaggaacaatcacagggccccctcaatgtgaccagtttctggagttttccgcggacctcattatcgagcgacgggaagggagcgacgtatgctacccgggaaaattcgtcaatgaggaggccctgcgtcagattcttagggagtcaggcggcatcgacaaggaagctatgggatttacatattctggaattcgcactaacggcgccacctccgcttgtcgacggagcggatcgtccttctatgccgaaatgaagtggctgctgtcgaatacggacaacgctgcttttccacaaatgactaagagctataagaataccagaaagtctcctgcgttaattgtatggggaatacatcatagtgtgtctaccgccgagcagacaaaactgtacggttccggcaataagctagtcactgtgggctcttccaattaccagcagtcgtttgtcccctcgccaggggcccgcccgcaagtaaatggacaatctgggcgtatcgatttccattggcttatgctgaaccctaatgacaccgtgacattttcattcaatggggctttcattgcccccgacagggctagcttccttcgcggcaagagcatggggatacaatccggggttcaagtggatgccaactgcgagggcgactgttaccactcaggcggaaccatcatttcaaatctgccctttcagaacattgacagccgcgccgtgggcaagtgtccacgatatgtgaagcagagatcactgctccttgcaaccggtatgaaaaatgttcctgagataccgaagggccgggggctcttcggtgctatcgctggattcattgaaaacgggtgggaaggactgatcgacggttggtatggatttaggcaccagaacgcacagggcgaagggaccgccgctgattataaaagcacgcagagcgctatagatcagatcaccggaaagctgaaccgcctgatcgagaaaacgaaccaacagttcgaactgattgataacgagtttaacgaagtggaaaaacagattggtaacgtgatcaactggactagagactccatcaccgaagtgtggtcatataacgcagagttactcgtcgcgatggaaaaccaacacaccatcgacctggcagacagtgagatggataaactctacgaacgggtcaagagacaactacgtgagaatgccgaggaagatggcacaggttgttttgaaatttttcacaagtgtgacgacgactgcatggcatcaataagaaacaatacttacgaccatagtaagtaccgggaggaagctatgcagaatagaatccaaatagatccagtgaaattgagtagcggatataaggatgtgattctatggtttagcttcggcgctagttgttttatccttttggctatagtgatggggctcgtttttatctgcgtgaagaacggaaacatgagatgtacgatctgcatt

SEQ ID NO: 652 - DNA, 1680 bp, Influenza A virus
  misc_feature (1)..(1680): Codon Optimized Sequence Encoding H7 Hemagglutinin
atgaatacccaaattctcgtttttgccctcatcgccattatccctactaacgccgataagatctgtctggggcatcatgccgtctccaacgggaccaaggtaaacactctgaccgagcgcggtgtcgaagtagtcaatgctacagagacagttgaacgcactaatattcccaggatctgtagtaaaggaaagcgtaccgtggacctaggacaatgtggcttgctcggcactatcaccggccctccacagtgcgaccaatttctggaattctccgctgatctgattatcgagagaagagaaggcagtgacgtgtgctacccgggaaagtttgtcaacgaagaggccttaaggcagatcctgcgcgagagcgggggtatagataaagaagccatgggcttcacttacagtggaattaggacaaacggcgccacgtcggcctgcagaaggtctgggtcctcattctacgccgagatgaagtggcttctgtcgaataccgacaatgcagcatttccacaaatgactaaatcctataagaacacccggaagtcaccagccctcatagtgtgggggatccatcactccgtgagcactgcagagcaaacaaagctgtatgggtccgggaataaactggtaaccgttggcagtagcaattatcagcagtcatttgttccctccccaggtgcccggcctcaggtgaatggtctgtctggtcgcatcgactttcactggctgatgctgaatccaaatgatacagtcacattttcgtttaatggagccttcatcgcgcccgacagggctagcttcctacgcggcaagagcatgggcattcagagcggcgtccaggttgacgccaattgcgagggagattgttatcatagcggaggcacaatcatctcaaacctcccctttcagaatatagactccagagccgttgggaagtgccctagatacgtgaaacagcgatccctgctcctagctacaggaatgaagaatgtgccagaaatccccaagggtcgggggctctttggagccatcgccggttttatcgaaaatggttgggaaggcctcattaatggctggtacggctttcgacaccagaatgcccagggtgaaggaacagcggcagactataagtccacacagagtgctatagaccagatcaccggcaagcttaacagactgattgaaaagaccaatcagcagttcgagttgatcgacaacgaattcaacgaggttgagaaacaaataggaaacgtgataaattggacccgcgattctataacagaagtgtggtcatataatgcggaactgctcgtggcaatggagaaccaacatacaatagaccttgcagactccgaaatggataagctgtacgagcgcgtcaagcgacagctcagagaaaatgcagaggaggatggaacaggctgttttgaaattttccacaagtgtgacgacgattgcatggcctccatcagaaataacacatatgaccattcaaagtatcgcgaagaagctatgcagaatcgaatccaaatagatcctgtgaagttgtcgtccggctacaaagatgttatcctgtggttcagtttcggggcctcatgcttcatcctgctggccatagtgatgggtctcgtgttcatctgcgtgaagaacggcaacatgcgctgcactatctgcatt

SEQ ID NO: 653 - DNA, 1680 bp, Influenza A virus
  misc_feature (1)..(1680): Codon Optimized Sequence Encoding H7 Hemagglutinin
atgaatacccagattttggtgttcgcacttatcgcaataatcccgactaacgctgataaaatttgtttaggacatcatgccgtttctaacggaactaaggtgaacacacttaccgagagaggtgtggaagtggtgaacgctaccgaaactgtggagcggactaacatcccccggatatgctcaaagggcaagagaactgtggatttaggtcaatgtggtctactgggcacaattaccggcccaccccaatgcgaccagttcctggagtttagcgccgacctgattattgagagacgtgagggctcagacgtatgttatcctgggaaatttgtcaacgaagaagccttgcggcagatcctacgtgagagcgggggcattgacaaagaggccatggggtttacatactcaggcatccgaactaacggggcaacaagtgcatgtagacgatctgggtctagcttctatgccgagatgaaatggctcctctcgaacaccgataacgccgcttttccgcagatgactaaatcttataagaatacaaggaagtcccccgctttaattgtctggggcatccaccactctgtgagcaccgccgaacagacaaaattgtacggctcggggtccaagcttgtcactgtgggctcatccaattaccagcaaagctttgtgccctcccccggggcaagacctcaggtgaacgggttgagcggaaggattgatttccattggctgatgttgaaccctaacgacacagtcaccttctcgtttaacggggccttcattgccccagatagggcctcttttctgcgcggaaagtcgatggggatccagtcaggggtgcaggtggacgccaactgtgaaggcgactgttatcacagcggaggaacgataatttccaatctaccctttcagaatatagattcaagagccgttgggaaatgtcccaggtacgtcaagcagaggtcgctcctcttggctaccggcatgaagaatgttcctgaaatcccgaagggcagaggactctttggcgccatagccggctttattgaaaatggatgggaaggattaattgacggctggtacggcttccggcatcagaatgcacagggcgagggcacggcggctgactacaagtctactcagagtgccatagaccagattaccgggaagttaaatcgtctgatcgagaagaccaaccaacagtttgaactcattgacaatgagttcaacgaagtggagaaacagatcggcaacgtaatcaattggactcgcgattccattaccgaggtgtggtcttataacgcagaactcttggtggccatggaaaaccaacacacgattgatctcgcagacagcgagatggacaagttgtatgagagagttaagcgccagctcagggagaatgccgaagaggacggaaccggttgctttgagatctttcacaaatgtgatgatgactgcatggcgagcattcgtaataatacttatgaccatagtaaataccgggaggaagccatgcagaatcgcatccaaattgaccccgtaaagctaagttcaggttataaggatgttattctttggttttcattcggagcttcatgcttcatccttcttgcaattgtaatgggactggttttcatttgtgtaaagaacggaaatatgcgatgtacgatttgtatt

SEQ ID NO: 654 - DNA, 1680 bp, Influenza A virus
  misc_feature (1)..(1680): Codon Optimized Sequence Encoding H7 Hemagglutinin
atgaatactcaaatccttgtctttgcgctgatcgctatcattccaacaaatgcagataaaatctgtctaggacatcatgctgtgtcaaacggtactaaagtgaatacactgacggagaggggagtcgaggtggtgaacgcaacagagacagtggaacgcacaaatatcccccgcatctgttctaaggggaaaaaaaccgtggacttggggcagtgcggtttactggggaccattactggtccgccccagtgcgaccagttcctagagttttccgcagacctgattatagagagacgcgaaggaagcgacgtatgttaccccgggaagtttgtcaatgaagaagccctcagacagattcttcgggagtccggaggcatcgataaagaggctatgggcttcacctactccggcattcgtacaaatggtgctacgtctgcctgtcgacgcagtgggtcatccttttacgccgaaatgaagtggctattgagcaataccgacaacgcagctttccctcagatgactaagagctataaaaacacccgcaagagcccagctctgatcgtatggggaattcaccactcagtttcgactgcagagcagactaaactgtatggctccgggaataagctggttaccgtgggtagctctaactaccagcagtcattcgttccttcacccggcgcacgcccccaagtgaatgggcaatctgggcgcatagacttccactggcttatgctaaacccaaacgacactgtgaccttttcattcaacggcgcattcattgcacctgaccgcgcgtcatttctccggggcaagagcatggggatccagagcggcgtacaggtggacgcgaattgcgagggggattgctaccattcaggaggaaccattatttctaacctcccgttccaaaatatagactctcgtgctgtgggaaagtgcccgagatacgtcaaacagcgttctctactcctggctacggggatgaagaacgtgcccgagattccgaaagggcgcggactgtttggcgccatcgcgggatttattgagaacggctgggaggggcttattgatggttggtatggcttccggcaccagaacgctcagggggaggggactgcagctgattacaagtcaacacaatcagcaatcgatcagattaccggaaagctgaacagactcatcgagaagacgaatcaacagtttgaattgatcgataacgaattcaacgaagtcgagaaacaaatcggaaacgtcattaactggactagagattccatcaccgaggtgtggtcttataacgccgagctcctggtggcgatggagaaccagcacacaattgatctcgctgacagcgagatggacaagttgtacgagagggtaaaacgacagctccgggaaaatgccgaggaagatgggacagggtgcttcgagatctttcacaagtgtgacgacgactgtatggcctcaattcgaaataacacctatgatcactcgaaataccgcgaggaagctatgcagaacagaatccagattgaccctgtgaagctgagcagtgggtataaagacgtcatcttatggttcagcttcggggcttcttgcttcatactgcttgccatcgttatgggcctggtgtttatctgtgtcaagaatggtaacatgaggtgcactatctgtata

SEQ ID NO: 655 - DNA, 1680 bp, Influenza A virus
  misc_feature (1)..(1680): Codon Optimized Sequence Encoding H7 Hemagglutinin
atgaacacccaaattcttgtatttgctctgatcgccattattccaaccaatgccgacaagatctgtttggggcaccatgccgtttctaatggcacaaaagtcaatacattaactgagcgcggcgtagaagtcgtgaacgctaccgaaacagttgagagaaccaacatccctcgaatatgttccaaggggaagaaaacagtggatctcgggcagtgcggcttgctgggaacaataactggcccgcctcagtgtgatcagttcctggaatttagtgctgacctgataatcgagcgaagagaggggagcgatgtgtgttatcccgggaaatttgtaaacgaggaggccctgcggcagatacttagagagagtgggggaatcgacaaagaagcgatggggtttacctactctggaatcagaactaacggggctacaagcgcctgccggcgcagcggatcgtccttctacgcagagatgaagtggctgctcagcaacactgacaatgccgcttttcctcaaatgaccaagtcttacaagaacacccgtaaaagtcccgcgctcatagtatggggtatccaccattctgtctcaacagcagaacagaccaaactgtacggcagcggcaacaaactggtgacagtgggatctagcaattaccagcagagttttgtcccatcccctggcgcgcggccccaggtgaatgggcaaagtggacggatagacttccactggttgatgctgaacccaaatgataccgtgacattttctttcaacggtgcatttatagcccctgaccgtgcaagcttcttgagaggtaagagcatgggaattcagtcaggtgttcaggtggatgccaattgcgagggcgattgctaccacagcggcggcactattatttctaatcttcctttccagaatatagactcccgtgctgtgggtaaatgccctaggtacgtaaagcaaaggagcttactgttggcaacaggcatgaagaatgtgccagaaattcccaaggggcggggcctgtttggcgccattgcaggctttattgagaatggctgggagggcctaattgatggttggtacggcttcaggcaccagaacgcacagggggaaggcacagctgcggattacaaaagtacccagagcgccatagatcaaataaccggcaagttaaaccgattgattgagaaaacaaaccagcaatttgagctgatagacaatgaattcaacgaagtcgaaaagcagattggcaacgtgatcaattggacccgggatagcattactgaggtatggagctataatgcagagttgctggtggccatggaaaaccagcataccatcgatctggccgactcagaaatggataagctctacgagcgggtgaagaggcagctgagagaaaatgccgaagaagacggaaccggctgctttgagatttttcacaagtgcgacgatgattgcatggccagtattagaaacaacacctatgatcactccaagtaccgcgaagaagccatgcagaaccgcatccaaatcgatccggtcaaactctcctctggctataaggatgtaatcctgtggttctcttttggagcgtcctgcttcatattattggctattgtgatgggcttggtgtttatctgtgttaagaacggaaacatgcggtgtacaatctgcatt

SEQ ID NO: 656 - DNA, 1680 bp, Influenza A virus
  misc_feature (1)..(1680): Codon Optimized Sequence Encoding H7 Hemagglutinin
atgaatacacagatactcgtgttcgcccttattgctatcatccctacaaatgctgacaagatatgtctgggccaccacgccgtgagcaatggcaccaaggttaataccctaaccgaacggggagttgaggtggttaacgctaccgagaccgtagagcgcactaatattccacgcatttgctcgaaaggcaagaaaacagtggacttaggccaatgtggactcctcggaacaataaccggcccaccacagtgcgatcagttcctcgagttttcagccgacctaattattgagcgacgggaaggtagcgatgtgtgttatccagggaagttcgtcaatgaagaggccttgcggcagatactgcgcgaaagtgggggcatagacaaggaggctatggggtttacatacagtggaattcgcaccaatggggccactagcgcctgtaggagatcaggctcctctttctacgctgagatgaaatggttactgtcaaatactgataacgccgcctttcctcagatgacaaaatcctataagaacactaggaagtcacctgctctaatcgtttggggaatccatcactccgtgagcaccgctgagcagaccaagctttatggctcaggaaacaagctcgtgacggtgggctccagtaactatcaacaaagcttcgtgccttctccaggagcaaggccccaggtgaatggacagtccgggagaatcgactttcactggctcatgctgaatccaaacgataccgttaccttttcattcaatggggccttcatcgccccagacagggccagcttcctccgcggcaaaagcatgggcatacaaagcggcgtgcaggtggatgctaattgcgagggtgactgctatcattcaggcggcaccataatcagtaacctgccctttcaaaatatagattcgcgggcagtaggtaaatgccctcgttatgtgaaacagcggtccttgctgcttgcgactggaatgaaaaacgtgcccgagattcccaagggccgtggattatttggcgctatcgccgggttcatcgagaacggctgggagggtctcattgatggatggtacggtttcagacaccagaacgcccagggggaggggaccgcagccgactacaaatcaacccagtccgccattgatcagatcacagggaagctaaatcgcctgattgagaagacaaatcagcagttcgagctgatcgacaacgaattcaatgaggtagagaaacagattgggaacgttattaattggaccagagattccataacagaggtatggtcttataacgcagaactgctcgttgcgatggagaaccagcatacaatcgacctggcagacagtgaaatggacaagctctatgagagggtcaagaggcaattgagagagaatgccgaagaagacgggaccggttgcttcgagatcttccacaaatgtgatgatgactgcatggcaagcattagaaacaacacctacgatcactccaaataccgagaggaggctatgcaaaatcggatacagatcgatcctgtcaagctgtcttctggttacaaagatgttattctgtggttcagttttggggcctcatgtttcatcttactggcaatcgtgatgggactcgttttcatctgtgttaaaaatggcaacatgaggtgtaccatttgtatc

SEQ ID NO: 657 - DNA, 1680 bp, Influenza A virus
  misc_feature (1)..(1680): Codon Optimized Sequence Encoding H7 Hemagglutinin
atgaacacacaaattttagtgtttgctctgattgccattatccccaccaacgctgataagatttgtctggggcaccacgcagtgtctaatggcaccaaagtcaacacacttacagagagaggagtggaggtggttaacgccactgaaaccgtcgagagaaccaatattcctcggatctgctccaagggcaagaaaacagttgatctaggacagtgtgggttgctagggacaatcaccggaccacctcagtgtgatcagttcttagagttctccgctgatctaattattgagcgaagagaagggtccgatgtgtgctaccccggtaaatttgtcaatgaagaagccttgaggcagattctgagagaaagcggcggcatcgataaggaggcaatgggtttcacttactctggaatccggaccaacggagccactagcgcttgtcgaaggagtggatcgtccttctacgccgagatgaaatggctcttgtcaaatacagataatgccgcatttccccagatgactaagagctacaagaatacacgtaagagcccggctctgatcgtctggggtattcatcatagtgtgtctactgcagagcagaccaaactatacggtagtggcaacaaacttgtcaccgtcggcagttctaattaccagcaatcctttgtcccttcccccggcgctcggcctcaggtgaatggacagagcggcaggattgacttccactggcttatgctgaaccctaatgatactgttaccttctcgtttaatggggcgtttattgctcccgatagggccagttttcttcggggcaagtccatggggatccagtcaggtgtgcaggtcgatgctaattgtgagggcgactgctatcattctggcggcacgatcatctcaaacttgcccttccaaaatatagatagccgagcagtgggaaaatgccctcgttacgtcaagcagaggagcctcctgttagccaccgggatgaaaaatgttccagaaatacccaaggggaggggcttatttggcgctattgcaggatttatcgagaacggttgggagggactcattgacggatggtatggcttccgccaccagaacgcccagggggagggtaccgcagctgattacaagtccacacagagtgccatagatcaaatcaccggtaagctgaataggctgatcgaaaaaaccaatcagcagtttgagctcatcgataatgagttcaacgaggtggagaaacagattggtaatgtcatcaactggacaagggactcgattaccgaagtgtggagctataacgcagagctcttggttgccatggagaatcagcacaccatcgatttagcagatagcgaaatggacaaactatacgaaagggtgaaacggcaacttagggagaacgccgaagaggatgggaccgggtgcttcgaaatttttcacaagtgtgatgacgactgcatggcctctatccggaataatacctacgatcacagcaaatacagggaggaagccatgcagaaccgcatccagatcgatccagtcaagctgtcttctggctataaggacgtgatcctgtggttctctttcggcgctagttgttttatcctgctggccatcgtgatgggccttgttttcatctgtgtgaaaaacgggaatatgaggtgcacaatctgcatt

SEQ ID NO: 658 - DNA, 1680 bp, Influenza A virus
  misc_feature (1)..(1680): Codon Optimized Sequence Encoding H7 Hemagglutinin
atgaacacacagatcctcgtctttgcactcatcgcaatcatccccaccaacgctgataaaatttgtctcggacatcatgccgtgagcaatgggaccaaagttaacaccctaacggagagaggtgtcgaggtggtgaacgcgacagaaaccgtagaacgaaccaatattccaaggatctgcagtaagggaaaaaggaccgtggatttggggcagtgtggattgctggggactatcacaggaccaccacagtgcgaccaattccttgaattttccgcggatctgattattgagaggagggagggatctgacgtctgttacccaggcaagttcgttaatgaggaagcgctgagacagattctgcgagagagcggaggcatagacaaagaggctatgggttttacctattctgggatacgcacaaacggagctacaagcgcatgccggagaagtggaagctcattttatgcggaaatgaaatggctcctctccaacaccgacaatgcagcattccctcagatgaccaaatcatataaaaacaccagaaaaagtccggctctcatagtgtggggtatacatcattccgtctcgaccgcagagcaaactaagctctacggctctggaaacaaactcgtgactgtcggcagttctaattaccagcagtcttttgtacctagccccggggctaggccacaggtgaatggcttatctgggcgcatagacttccactggcttatgctgaacccaaacgatacagtgaccttctcctttaacggcgccttcattgcccccgacagagctagtttcctgcgcggaaaatcaatgggaatccagagtggggtgcaggtggatgcaaactgcgaaggcgactgctatcactcaggcggcacaataattagtaacctaccattccagaacattgattcacgcgccgtcgggaagtgtccgagatacgtgaaacagcggtctctcctgttagcaacaggcatgaagaatgtgcctgagattcccaaaggccgggggctcttcggagccattgctggtttcatcgagaacgggtgggagggtctgatcgatggctggtatggtttccggcatcagaacgcgcagggggagggcacagccgcagattacaagagtactcagagtgccatcgatcagattacagggaagctgaatagaataatcgaaaaaactaatcagcagtttgaactgatagacaacgaattcaacgaggtcgagaagcagatcgggaatgtgatcaactggacccgcgactcaatcacagaggtttggagttataatgccgagctcctcgttgccatggagaatcaacatacaattgaccttgctgactctgagatggataaactgtatgaacgagttaagcgacagttgagggagaatgcggaagaagacgggaccggctgcttcgaaatattccataagtgcgacgatgactgtatggcatcaatcaggaacaacacctatgaccactccaagtatcgagaggaagcgatgcagaacaggatccagatcgatccagtcaagttgtcctctggctataaggacgtgattctgtggttttctttcggcgcaagctgtttcattttattagctatcgtcatgggtctagtgttcatctgtgttaaaaatggcaatatgcgatgtacaatctgtatt

SEQ ID NO: 659 - DNA, 1680 bp, Influenza A virus
  misc_feature (1)..(1680): Codon Optimized Sequence Encoding H7 Hemagglutinin
atgaacacccaaatccttgttttcgctctgattgcaattatcccaacgaatgctgacaaaatttgcctgggccaccacgctgtgtccaacggaactaaggtaaatactctgactgaacgcggcgtggaggtggtgaacgccaccgaaacagtggagagaactaatattccccgcatctgttctaagggcaaaaagacagtggatctcggtcagtgcgggctgttgggaacaattaccggacctccccaatgcgatcagttcctagagttttccgccgacctgataatcgaaagacgtgaaggctctgacgtgtgttaccccggaaagtttgtgaatgaagaagcactgcggcagatcttacgcgagagtggcggcattgacaaggaggcaatgggatttacctactccggaatcaggacaaatggcgcaaccagtgcttgtaggcgctccggaagctccttttatgccgagatgaaatggcttctgtccaacacggacaacgccgctttccctcaaatgaccaaatcctacaaaaatacccgtaagtcaccggcgctgattgtatgggggatacaccacagtgtttctaccgccgaacaaaccaagctgtacggcagcggaaataaactggtaactgtcggatcatccaattaccagcagtccttcgtccctagccctggggcgcgcccgcaggtcaatgggcagtctggaagaattgactttcattggctgatgttaaatccaaacgacacagttacattcagtttcaacggggcctttattgcacccgatagagcatcctttctgcgaggcaaaagtatggggattcaatctggggtgcaggttgatgcgaattgcgagggagattgctatcactctggcggaaccatcatcagcaacctcccattccaaaatattgactcacgcgctgtgggaaagtgccctaggtatgtgaagcagcggtccttgcttttagctaccggaatgaaaaacgtgccagaaatccctaaggggcgcggattattcggcgccattgctggcttcattgagaatggatgggagggcctaatcgacggttggtatggttttcgtcatcagaacgcacaaggggaagggactgctgccgactacaagtctacccagtccgctatagaccagattaccggtaagctaaatcggcttatagagaagactaaccaacagttcgagctgatcgacaacgaatttaacgaagtggagaagcagattgggaacgtcatcaactggacgcgagactctattactgaagtctggtcttacaatgctgagttgctcgtggctatggaaaaccagcatactatagacctggccgactcagagatggataagttatatgaacgcgtgaagcggcagctccgagaaaatgccgaagaggacggaacagggtgttttgagatcttccacaaatgtgacgatgactgcatggcatctatacggaacaatacctatgaccattccaagtaccgtgaggaagccatgcaaaatagaatacaaatcgatccagtcaaactctctagcggctacaaggacgttatcttgtggttctccttcggagcgagctgttttattttgctcgcgattgtgatgggattggtgtttatttgcgttaaaaacggaaacatgcggtgcaccatctgtatc

SEQ ID NO: 660 - DNA, 1680 bp, Influenza A virus
  misc_feature (1)..(1680): Codon Optimized Sequence Encoding H7 Hemagglutinin
atgaatacccagatcctggtcttcgctctgatcgcaatcattcctaccaacgctgacaaaatttgcctgggccaccacgcagttagtaatggaacaaaagtgaatactcttacagagcggggtgtcgaggtagtaaacgctacggaaaccgtagagcgcacaaatatccccagaatctgtagcaaaggtaaaaggacagtagacttgggccagtgtggactgctcggaacaattacaggcccccctcagtgtgatcagttcctggaattctcagccgaccttatcatcgaacgaagggaggggagcgatgtctgctacccaggcaagtttgtgaatgaagaggcccttcgtcaaatactccgagaatcggggggaatcgataaagaagcaatgggatttacctatagcggaatcagaactaacggcgcaacttccgcctgcaggcggtctggcagctccttttatgccgagatgaagtggctattgagcaatactgacaacgcagccttccctcaaatgaccaagtcatacaaaaatacacgcaagtctccagctctgatcgtgtggggcattcaccatagcgtcagcacagccgagcaaacaaagctctacggcagcggcaacaaactcgtgaccgtcggcagttctaactaccagcagtcctttgtgcccagcccaggggcccgtccacaggttaacggactgtctggccggatcgatttccactggctgatgttaaatcccaacgacacagtcacgtttagctttaacggagcctttatcgcccccgacagggctagctttcttaggggcaagagcatgggaattcaatcaggggttcaagtggacgcaaactgcgagggcgattgctatcactccggtggaactattataagtaatctaccattccaaaacatcgattcaagggcggtgggtaagtgtcctcgctacgttaagcagcgcagcctgctactcgcgacgggaatgaaaaatgtcccggagatacctaaaggcagaggcctcttcggcgccatcgcaggtttcatcgaaaacggctgggaaggtctgatcgacggttggtatggattccgtcaccaaaacgcacagggagagggtacagccgcagactataagtctacccagtcagctatcgaccaaattactggaaaactgaatcgtatcattgaaaagaccaatcaacaattcgagctgatcgacaacgagtttaatgaagttgagaaacagatcggaaatgtgattaactggacacgtgacagcattactgaggtctggagctacaacgcggaacttctcgtagcgatggagaaccagcacactattgacctggctgatagtgaaatggataaactatatgaaagggtcaaaagacaactgcgggaaaatgccgaggaagatggtactggatgttttgaaatctttcacaagtgcgatgacgactgtatggctagcatcaggaacaatacatacgaccattcgaagtatcgcgaagaggccatgcagaaccgaatacagattgatccggttaagctgtcttctggatataaagacgtcatcctgtggtttagtttcggggcgagttgtttcattctactggctattgtcatgggcctggtttttatctgcgtgaaaaatggcaacatgcggtgcacgatctgcatc

SEQ ID NO: 661 - DNA, 1680 bp, Influenza A virus
  misc_feature (1)..(1680): Codon Optimized Sequence Encoding H7 Hemagglutinin
atgaacacacagatcttggtgttcgccctcatcgcgataatacccactaatgccgacaaaatttgtttgggtcatcacgccgtgagcaatggcactaaggtgaacacgcttacagaacggggcgtagaagttgtgaacgccacagagacagtggagaggacaaatatcccgcggatctgctcaaaggggaaaaaaaccgttgacctgggacagtgcggcctgctggggacaataacaggccccccccagtgtgaccaatttctggagttctctgccgacctgattatcgaaagacgggagggcagtgatgtctgctaccccggcaagttcgtaaatgaagaggctctgcggcagatcctacgggagtccggaggaatcgataaggaggcaatggggtttacgtatagcggcattagaaccaacggagcaaccagtgcttgcaggaggagcggcagctcattctacgcggaaatgaagtggctgctgtcaaatacagataacgccgctttcccacagatgactaaatcctataagaacacccgcaagagtcctgctctcatcgtttggggtatccaccactctgtgtcaactgccgagcagaccaaactttacggatctgggaataagcttgtgacagttgggagcagcaactatcagcagtcatttgtgccctctccgggtgccaggccacaggttaatggacagtcggggcgtatcgacttccattggcttatgctcaatcctaatgacactgttaccttttctttcaacggcgcgttcattgcccccgacagagcgagctttcttagggggaaatcgatgggtattcagagcggggtccaggtcgatgcgaactgcgagggcgattgctaccactcagggggaacaattatctctaatttaccctttcagaacatcgactcaagggcagtggggaagtgtccgcgatacgttaaacaacggagtttgctcctggccacaggcatgaaaaacgtcccagaaatccccaaaggcagagggttgtttggggcgatcgccggctttatcgagaacggatgggaaggcttaattgacggctggtacggcttccgccaccagaacgctcagggggaaggtaccgccgctgattataaaagtacgcaaagcgctattgatcagattacgggcaaattgaatcggctgattgagaaaacaaatcagcagtttgaactgatcgacaacgagtttaatgaggtggagaagcagataggaaatgtaattaactggactcgggattcgatcacggaggtttggtcctataacgcagagctactggtcgccatggagaatcagcacactattgacctggcagattctgagatggacaagctgtacgagagggtaaaaagacaactgcgggagaacgctgaagaggatggaacagggtgttttgagatctttcacaagtgcgacgatgattgcatggcatctatccgcaacaatacttacgaccactctaagtacagagaagaggcgatgcagaatcgaattcagattgacccggtgaagctgagcagtggatataaagatgtaatcctctggtttagcttcggagcctcatgttttatcctccttgctatcgttatgggcctcgtctttatatgtgtcaaaaacggcaatatgcgctgcacaatctgcatt

SEQ ID NO: 662 - DNA, 1680 bp, Influenza A virus
  misc_feature (1)..(1680): Codon Optimized Sequence Encoding H7 Hemagglutinin
atgaatacccaaattttggtttttgctctgattgccattattcccactaatgccgacaagatctgcctcggccatcatgccgtgtctaatggcacaaaggtgaataccttgacagaaaggggtgtggaagtagtgaatgccacagaaactgtagagcggaccaatattcccaggatttgctctaagggaaagaagaccgttgatctgggccaatgcggcttgctgggcaccatcactgggccaccacagtgcgaccagttcctggaatttagcgccgatctgataatagagagacgggaaggtagcgacgtctgctatcctgggaaattcgtcaacgaggaagctctgcggcagatcctacgggagagtggcgggatagacaaggaggcaatgggctttacgtactcaggaattcgaaccaatggggcgacgtccgcctgccggagatcgggctcttctttttacgcagaaatgaagtggctgctgtcgaatacagataatgcggctttcccccagatgaccaagtcatataaaaatacgagaaaatcgcccgcacttattgtgtggggcatccaccactccgtgtcaactgccgagcaaaccaagctatatggcagcggcaataagctggtgacagtaggaagttctaattaccagcagtctttcgtgccgagccctggagccagaccacaggtgaatggccagtcgggcaggatagatttccactggttaatgcttaacccaaacgacacggtgaccttcagtttcaacggtgccttcatcgcccccgatcgcgcctcctttttgcgcggcaagtctatgggtattcagagtggagtgcaggtggacgcaaactgcgaaggggattgttatcacagcggcgggaccataatcagcaatctcccgtttcaaaatatcgattctcgggcagtcggtaaatgtcccaggtacgttaagcaacggagcctgctgctcgctacaggcatgaagaatgtgcccgagatccccaagggaagaggcctgttcggggccatcgctggtttcatcgagaacggatgggagggattaatcgacgggtggtacggtttccgacaccagaacgcacagggtgagggcactgccgctgattacaaatcaacccagtctgcaatcgaccagatcactgggaaattgaaccgattgatcgaaaagacgaaccagcagttcgaactcattgacaacgagtttaatgaagtcgagaagcagattggaaatgtgatcaactggacaagggattctatcacagaggtctggtcatacaacgctgaactccttgtggccatggagaaccagcacaccatcgatctggctgattcagaaatggataaactatatgaaagggtgaagcggcaacttagggaaaatgctgaggaggacggcacgggatgctttgaaatcttccacaagtgtgatgatgactgtatggcgtccatccggaacaatacatatgaccattcaaaatatagagaagaggcaatgcagaacaggatacagattgaccctgtcaagttgagttctggctacaaggacgtgattctgtggttcagcttcggagccagttgtttcatcctcctggccatcgtgatgggcctagtgttcatctgcgtgaaaaatggcaatatgcgctgcacaatatgtata

SEQ ID NO: 663 - DNA, 1680 bp, Influenza A virus
  misc_feature (1)..(1680): Codon Optimized Sequence Encoding H7 Hemagglutinin
atgaatacccaaatcctcgttttcgcactgattgctattatacccaccaacgctgacaagatttgtctgggtcaccacgcagtttctaacggcacaaaggtgaatactctcacagagcgcggggttgaggtcgtcaacgctactgagaccgtcgaacgaaccaatatccccaggatctgtagcaagggaaagaaaacagtcgatttaggccagtgtggcctcttaggcaccatcacaggcccaccccaatgcgaccagttcctggagttctccgcagatttaatcattgagcggcgagaggggagtgatgtttgctacccaggtaagttcgtcaatgaagaagccttgcgccagatcctgcgggaaagcggcggcattgacaaagaggctatgggatttacttattctggcatacgaactaacggggcaacgtctgcttgtcgacgctcaggctcatccttctacgcagaaatgaaatggttgctcagtaatacagataatgccgcatttccccaaatgaccaagagctacaagaatacacggaagagcccagccctgattgtgtggggtatccaccattctgtaagtacagcagagcagacaaaactgtatgggtctggcaacaaactggtgacggtgggcagtagcaactaccaacagagtttcgtgccgtcacctggggcaagaccccaggttaacgggcagtccggccgcatagactttcactggctcatgctgaatccgaacgatacagtgactttttcattcaatggtgcatttatcgcccccgatcgcgcttcgttcctccgcggcaaatctatgggaattcaatccggggtacaggtcgacgccaactgcgagggcgactgttaccattccggcgggactattataagtaatctaccttttcagaacatagattccagagccgtgggaaaatgccctcgctacgtgaaacagaggtccctgcttctggctactggaatgaagaatgttccagagatacctaagggacggggccttttcggggcaatcgccggattcatcgaaaatgggtgggaagggctgatcgatggctggtacggctttcgccatcagaacgcacagggagagggtacagcggctgattacaaatcgactcaaagtgctatagatcagattaccggcaaactgaacaggctgatcgagaaaacgaatcaacagttcgaactgattgataacgagtttaacgaggtggaaaaacaaatcggaaacgttatcaattggacgagggacagcattaccgaagtgtggtcgtataatgcagagctgttagtcgccatggagaatcaacacaccatcgatcttgccgacagcgagatggacaagctttatgagcgcgtgaagagacaactgcgagaaaatgccgaggaagatggaaccggatgttttgagatattccacaagtgcgacgatgattgtatggcgagcatccgcaacaatacctatgatcactccaaatacagggaagaggctatgcaaaatagaatccaaattgatcccgtcaaactgtcaagtgggtacaaggatgtgatattatggttttcctttggcgcctcatgctttatactgctggctatcgtgatgggcttggtctttatttgcgtgaagaatggcaacatgcggtgtacaatatgtatt

SEQ ID NO: 664 - DNA, 1680 bp, Influenza A virus
  misc_feature (1)..(1680): Codon Optimized Sequence Encoding H7 Hemagglutinin
atgaatacacaaattctggtgttcgcactcattgctatcatacccactaatgccgataagatctgtctgggccaccacgctgttagcaacgggaccaaagttaacacccttaccgagaggggcgtggaggtggtcaacgcaaccgaaaccgtcgaacggacaaacatcccgaggatctgcagtaaaggaaagagaacagtcgacctcgggcaatgtggactgctggggactattacagggcccccccaatgtgatcagttcctggagttttctgcggatttaatcattgagaggcgggaggggagtgatgtttgttacccaggtaagtttgttaatgaagaagcgctgcgccagatacttagagagagtgggggaatcgacaaggaggctatgggttttacctacagcggcatcagaacaaatggcgccaccagcgcatgccgcaggagcggttcctcattctacgccgaaatgaagtggctcctatccaatacagataacgccgccttcccccagatgacaaagtcctacaaaaacacccggaagagccctgccctaattgtgtggggtatccaccactccgtgtctacggccgagcagaccaagctgtacggaagcggcaacaaactagtgaccgtaggatctagtaactatcagcagagtttcgtaccttcaccaggagcgcggcctcaggttaatggtctgagcgggaggatcgatttccattggcttatgctgaaccccaatgacactgttacgttttctttcaacggagcattcatcgctccagaccgcgcgagctttctccgaggaaaatcaatggggatacagtctggggtccaagtggacgctaactgtgagggggactgttatcactcaggtggaaccattatttctaacttgccattccagaacatagattcgcgagccgtgggcaaatgtccccgttacgtgaaacagcgttccctcctgctagccaccgggatgaagaacgtacccgaaattcctaaagggagaggcctctttggcgctattgcggggtttattgaaaacggatgggagggcctaattgacggctggtatgggttcagacatcagaatgcacagggtgaggggacagctgctgactacaagtccacgcagtctgcaatagatcaaataaccggcaaactcaaccgcttaatcgagaaaacgaaccagcagttcgagcttatagacaatgagttcaatgaggttgaaaaacagatcggcaacgtgattaattggactcgggactctatcaccgaggtctggagctataacgcagagttgctggtcgccatggagaatcagcacacaatagatcttgctgactcggaaatggacaaactttacgaaagggtcaagcggcagctgagggagaacgctgaagaagatgggacggggtgcttcgaaatttttcataagtgcgatgatgattgtatggcgtccattagaaataacacctacgaccatagtaaataccgggaggaagccatgcagaacaggatccagatcgacccagtaaaactgtcaagtgggtataaggatgttatattgtggttctcgttcggcgccagttgcttcatcctcctcgctattgtcatgggccttgtgtttatttgcgtgaagaatggaaatatgcgctgcaccatttgcatt

SEQ ID NO: 665 - DNA, 1680 bp, Influenza A virus
  misc_feature (1)..(1680): Codon Optimized Sequence Encoding H7 Hemagglutinin
atgaatacccagatactggtgtttgccttaatagcaattatcccaacaaatgccgacaagatctgccttggacaccacgccgtgtccaatggtactaaagtgaacaccttgaccgagcggggggtggaggtggtaaatgccacggagactgtcgaacgtacaaatatcccccgcatctgttctaaaggcaaaaaaactgtcgacttgggccagtgcggactactggggacgattactggtccgcctcagtgcgaccaattcctcgaatttagtgcagatctcattattgaaagacgagaggggagtgacgtttgctatccaggcaagttcgttaacgaggaagcccttaggcaaattttgagggagtcggggggaattgataaagaagcaatgggatttacttacagcggcattcggaccaacggtgctacctcagcatgcaggcgctctggctcctccttctacgctgagatgaaatggctactgtccaacaccgacaatgcagcatttcctcaaatgactaagagctataagaacacaagaaaatcccccgccctcatagtctgggggatccaccactcagtgtccaccgcagagcagacgaaattatatggatccggaaataaactggtgacagtggggagtagtaactaccaacagagttttgttcccagcccaggcgccagacctcaggtaaatggacagtccggaaggatcgattttcattggctcatgctaaaccccaacgataccgtcacattctcattcaacggagcatttatagctcccgaccgggcttcattccttcggggtaaatcaatgggcattcagtctggggtacaagtggacgccaattgtgagggcgactgctatcactctggcggaacaatcatatctaatctcccattccagaacatcgattcccgcgcagtcggcaagtgtccaaggtacgtgaaacagcgctccctgttgttggcaactggaatgaaaaatgtaccagagattcctaagggacgtggactgttcggagctattgcagggttcatcgaaaatgggtgggagggcctaatcgacggttggtatgggttcagacatcagaacgcccagggggagggtactgccgccgattacaagtccacccagtccgcaattgaccagatcacgggtaaattaaacagactcattgaaaaaactaatcagcagttcgagcttattgataatgaatttaatgaagtggaaaagcagatagggaatgtgattaactggacccgcgactctatcacagaagtctggtcatacaatgctgaactgcttgtcgccatggaaaatcagcataccatagaccttgcagattcagaaatggacaagctgtacgaaagagtcaaaagacagctgagggagaatgccgaggaggatggtacagggtgcttcgaaatcttccacaagtgcgacgatgactgtatggcgagcatccgcaataatacgtatgaccattctaaatacagagaagaggcgatgcagaatcggatccaaatcgacccggtaaagctcagttcgggctacaaagacgtaatactatggttctcctttggagcttcgtgcttcattctcctagctatcgtcatggggttagtcttcatctgcgtgaagaatggtaatatgcgctgtacaatttgtata

SEQ ID NO: 666 - DNA, 1680 bp, Influenza A virus
  misc_feature (1)..(1680): Codon Optimized Sequence Encoding H7 Hemagglutinin
atgaacacacagatcctagtgtttgccctcatcgccattattccaacaaacgctgataagatttgcctaggacatcacgcagtgtccaacggaactaaggtgaacaccttaactgagaggggagtagaggtggtgaatgccacagagactgttgaaagaaccaatattccccgtatctgctcaaaggggaagagaacggtagacctggggcagtgtggcttgctgggcaccatcaccggcccaccccagtgcgatcagtttttggaattctctgccgatttaataatagaacgcagagaaggttccgacgtgtgctaccctggaaaattcgtcaatgaggaagcactgaggcagatcttacgcgagtccggaggcatcgacaaagaggcaatgggattcacttactccggaatccggactaacggggcgacgagcgcctgcaggcgtagcggctcctctttttacgcggaaatgaagtggcttctatccaacactgacaatgccgcttttccacaaatgaccaagtcttataaaaacacacgcaagtcgcccgccttaatagtgtggggcattcatcattccgtgtcaacagcagagcagactaagttgtatggcagtggttctaagttggtgacagtaggatcctccaactaccagcaaagtttcgtgcctagcccaggcgcacgtccccaggtgaacggcctttcagggaggatcgatttccattggctgatgctcaaccccaacgacactgttactttctccttcaacggagcatttatcgcaccagatcgggcctccttcttgcggggaaaatctatgggaatccagagcggagtgcaggtggatgccaattgtgaaggggattgctaccactctgggggaacaattatctccaatttgcccttccagaatatcgattcccgagctgtcggaaaatgtccgaggtatgtcaagcagcgtagtctgctccttgccacgggcatgaagaacgtcccagagattcccaagggccggggcttattcggggctatcgccgggttcatcgagaacggatgggaggggctaatagacggctggtatggcttcaggcatcagaatgcacaaggtgaaggaacggcggctgattataaatccacccagagtgccatcgatcagattacaggtaagcttaaccggctaatcgaaaagacgaatcagcagtttgaactcatcgataacgagttcaatgaggtggagaagcagatcggaaatgtcatcaactggactcgagactcgatcactgaggtgtggtcctacaatgctgagcttctggtcgctatggaaaatcaacacaccatcgatctggcagactcagaaatggacaagttgtacgagcgggtgaagagacaactaagggaaaacgccgaggaagatggcactggatgctttgaaatctttcacaagtgcgacgatgactgcatggcttcaatcagaaataacacctacgatcacagcaagtacagagaagaagcaatgcagaaccgtattcaaatcgaccccgtcaagctgtccagcggatacaaggatgtgatcctgtggttctccttcggggcaagctgtttcatcctgctggctatagtgatgggcctggtcttcatttgtgtcaagtccaggaatatgcggtgtactatctgtatt

SEQ ID NO: 667 - DNA, 1680 bp, Influenza A virus
  misc_feature (1)..(1680): Codon Optimized Sequence Encoding H7 Hemagglutinin
atgaacacccagatactggtctttgctctcatagcgatcataccaaccaacgctgacaaaatctgtctggggcaccacgcggtgtctaacggcactaaggtaaacaccctcactgaacgcggtgtggaggtggtgaacgccaccgagaccgttgagcgtacaaatatacccaggatctgttccaagggtaaaaggaccgtcgaccttggccagtgtggcctgctgggcaccattacgggccctccccaatgcgatcaatttcttgagttcagcgccgatttgatcatagagcgacgtgaggggtcagacgtgtgttaccctgggaaatttgtgaaggaagaagcactgcgacagatccttcgagagtctggagggattgataaggaagctatgggcttcacctatagcggaatcaggactaacggcgctactagtgcgtgcagacgatctggaagcagtttttacgccgaaatgaagtggctgctgtctaatactgataatgccgccttcccacaaatgaccaagtcctacaagaacacacggaagtccccagctctgatcgtgtggggcatccatcactcggtctccacagccgagcaaacaaagctttacgggtcaggaaacaaattggtaaccgtgggctctagtaactatcaacagagcttcgtcccgtcccccggtgcacgcccacaggtgaacggtttaagtgggcgcatcgacttccattggctcatgctgaaccctaatgacacagtgaccttttcctttaacggggcattcatcgcccctgatagggcatccttcctccggggcaagagtatggggatacaatcgggggtgcaagtcgacgcaaattgcgagggtgattgttaccactctgggggtaccatcatttccaacctgccctttcagaacatagattcgagggctgtcgggaagtgccctcgatatgtgaagcagcggagtctcctgctggcaacaggcatgaagaacgtccccgagatccccaaaggacgaggactcttcggcgcaatcgccggttttatagagaacggatgggaaggcctgatcgacggttggtatggctttcgtcaccagaacgcgcagggtgagggcactgccgccgactataagagcacacagtccgccatcgaccaaattactggaaagcttaatagactaatcgaaaaaacaaaccaacagtttgagctgattgacaatgagtttaatgaggtggagaagcagataggtaatgtgataaattggacccgggattctattaccgaagtgtggtcatacaatgcggaactgctggtagcaatggaaaatcagcacacaatcgatctggccgatagtgagatggacaagttgtacgagagggttaagaggcagcttcgggaaaatgcagaagaggatggtaccgggtgttttgaaatcttccacaagtgcgatgacgactgcatggcttctatcagaaacaatacatacgaccacagcaaatatcgggaggaagccatgcagaaccgaatccagatcgatcccgtcaagcttagctcgggctataaagatgtcattctgtggttttcctttggagcctcctgtttcatcctcctagccattgtgatgggtcttgtgtttatctgcgtgaagaacggcaatatgaggtgcactatctgcatt

SEQ ID NO: 668 - DNA, 1680 bp, Influenza A virus
  misc_feature (1)..(1680): Codon Optimized Sequence Encoding H7 Hemagglutinin
atgaatacccaaattcttgtgttcgccctgatcgctattatcccgacgaacgccgataagatctgcctaggacaccacgctgtgagtaatggaaccaaggtgaacacactgactgagaggggcgtggaggtggtgaacgcgacagagaccgtggaacgaacaaatattccgaggatctgttcaaaggggaagagaaccgtggatctgggccagtgcggactgctaggcactattaccggcccaccacagtgtgaccagttcctggagtttagtgccgacctgattattgaaaggcgcgagggaagtgacgtttgttaccccgggaaattcgtaaatgaggaggccctcagacaaatactaagagagtccggcggaattgacaaagaggcgatgggctttacatacagcggtataagaacgaacggggcgacctccgcatgtaggcgtagtggctcaagtttctatgccgagatgaagtggctgctgagcaatacagacaatgccgcctttccccagatgaccaagtcttacaagaatacgagaaaaagtccagcactcattgtgtggggtatccatcattctgtgagcacagcagaacaaacaaagctgtacggctcaggaaacaagctcgtgactgtgggcagctctaactaccagcaatcattcgtcccctccccgggagccagaccacaggttaacggactgagtgggcgaattgatttccactggcttatgttaaaccccaatgatactgtgacattttctttcaacggcgcgtttatcgctccagatcgtgccagttttctgagggggaagtccatgggcatccagtccggagtgcaggttgacgccaattgtgaaggggactgttaccattctggtgggactattatttcgaacctacccttccagaatattgacagccgggccgttggtaaatgccctcggtacgttaaacaaagaagcctcctgctggcgaccggaatgaagaatgtgcctgaaattccgaaaggacgcggactgttcggcgctatcgcagggtttatagaaaacggttgggagggcttaattaacggttggtatggctttcggcaccagaacgcccagggcgaggggaccgccgccgactataaaagcacacagtctgcgattgatcagattaccgggaagctcaacaggctcatagagaaaacaaaccaacagtttgaactgattgacaatgaatttaacgaggtagaaaaacagattggcaatgttatcaactggaccagggattcaattacagaggtgtggtcttataatgccgagctattggtggccatggaaaaccaacatacaatcgacctcgccgattcagagatggacaagctgtatgagagggtcaaaagacagttgcgcgagaatgccgaggaggacgggactggctgcttcgagatctttcacaaatgcgatgacgactgtatggctagtatccgcaacaacacgtatgatcactctaagtaccgcgaggaagccatgcagaatcggatccaaattgatccagttaaactgtctagcggctacaaggatgtgattctgtggttttctttcggagcatcctgcttcatcttgttagccattgtgatgggcctggtttttatctgcgtgaagaacggcaatatgcggtgtactatctgcatc

SEQ ID NO: 669 - DNA, 1680 bp, Influenza A virus
  misc_feature (1)..(1680): Codon Optimized Sequence Encoding H7 Hemagglutinin
atgaatacgcagattctggtgtttgccttaatagctattatccccactaatgccgacaagatctgtttagggcaccacgctgtatcaaatggcaccaaagtcaatacgctcaccgaacggggggtggaagttgtgaacgcgactgaaactgtcgaaagaaccaatattccgcgaatttgcagtaagggaaagaagactgtggacctgggccaatgtggcttgttgggcaccattaccggtccaccgcagtgcgatcaatttcttgaattctctgcagacctgataatcgaacgccgcgagggctctgacgtgtgttatcctgggaaatttgttaatgaggaagccctcaggcagatactcagggaatctggcggtattgataaggaggccatggggttcacgtactctggtatacgcaccaatggtgccacatccgcatgcaggagaagcggctcctcgttctatgcagaaatgaagtggttgctgtcgaacacagacaacgccgcctttccacagatgacaaagagttacaagaacacaaggaagtcacctgccctgatcgtttggggtattcatcattctgtctccacagctgagcagaccaaactgtacgggtcaggaaacaagctggtgactgtgggttcctcgaattatcagcagagctttgttccgtccccaggtgcgaggccccaggtgaacggccaatccgggcgcatcgactttcactggctgatgcttaacccaaacgatactgtgaccttctcctttaacggagcgtttatcgctccagacagggcctcgtttctgagagggaaaagcatgggaatccagtcaggggtgcaggtggatgctaattgtgaaggtgactgttaccactcaggaggcacaatcattagcaacctgccctttcagaacattgactccagggcagtgggcaaatgtccacggtatgtgaagcagagaagcctcctcctggccacaggcatgaagaacgtgccagagattcccaagggtaggggcctgttcggtgctatagccggatttattgagaatggatgggaagggctgatcgacggttggtacggctttagacaccagaacgctcagggagagggaactgccgcagactataaaagtactcaaagcgcgatcgaccagataacaggtaagctcaaccgtctcattgagaaaacaaaccagcagttcgaactcatcgataacgagtttaacgaagtcgagaaacaaattggaaacgtcattaactggactagagattcaatcactgaggtgtggagctacaacgctgagctgcttgtggctatggagaatcagcataccatagatctggctgactctgaaatggataaactctatgaacgagtcaagagacagctcagggagaatgctgaagaggatggcacaggatgtttcgaaatcttccacaagtgtgacgacgactgcatggcaagcattaggaataacacatatgatcattctaaatatagggaagaggcaatgcagaatcggatccaaattgatccagtcaagttatcttccgggtataaagacgtgatcctttggttcagctttggcgcttcatgtttcatcttgcttgccatcgtcatgggactcgtctttatctgcgtcaaaaatggtaacatgagatgcacaatttgtatc

SEQ ID NO: 670 - DNA, 1680 bp, Influenza A virus
  misc_feature (1)..(1680): Codon Optimized Sequence Encoding H7 Hemagglutinin
atgaatacccagattttagtgtttgccctgattgccataatcccaactaacgccgataagatttgcttgggccaccacgctgtgagcaacggcaccaaagtcaacaccctgaccgaacgcggcgtggaggtcgtcaatgccaccgaaaccgtggagcgaaccaacattccacgcatctgttccaagggaaaaagaacggttgatctcggccagtgtggcctgctcgggacaatcaccgggccgccgcagtgcgaccagttcctggagtttagcgccgacctaatcatcgaacgccgggagggttctgatgtgtgctaccctggcaaatttgtgaatgaggaggcgcttaggcagattctcagggagtccggtggaattgacaaggaagccatgggtttcacatacagcggtattaggactaatggcgcaacatcagcttgtcgaagatctggttctagcttttacgcagagatgaaatggcttctatccaatactgataatgcagcttttccccaaattacaaagtcatataaaaacacccgcaaatcgcccgctctcatagtgtggggaattcaccattccgttagtaccgctgaacagaccaaattgtatgggagcggtaacaagctggtcaccgttgggtcctccaattatcagcagtcgttcgtgccgagtcctggagcccgcccccaggtcaacggcctttctggccggattgactttcattggctgatgttgaaccctaacgacacagttacattctcatttaatggagccttcatcgctccggatcgagccagcttcctccgtggtaagagtatggggatccaaagcggtgttcaggtcgatgccaactgcgagggcgattgttatcattcagggggtactataatcagcaacctgccctttcaaaacatagacagcagggcagtcggaaaatgtcctcgatatgtcaaacaacggtctctgttgctggctacagggatgaagaacgtgccggagatccccaaaggacgtggattatttggggccatagccgggtttattgagaatggatgggagggcctgattgatggatggtacggttttcgccatcagaatgcacagggagaaggaacagctgccgactacaagtcaacgcagagtgctattgaccagataactggcaagttaaaccggctgatcgaaaagactaatcaacaatttgagttgatcgacaatgagtttaatgaagttgagaaacagatcggcaacgtcatcaactggacgcgcgatagcattacagaagtctggtcttataacgccgagttgcttgtagcaatggagaaccagcataccattgatctcgcggacagtgaaatggacaagctctacgagcgcgtaaagcgacagctaagagaaaatgcagaagaagatgggacgggatgtttcgaaatcttccacaaatgcgatgacgattgcatggccagcatacggaataatacctacgatcattccaagtatcgggaagaggccatgcagaaccgcattcagattgatcccgtgaaactttcaagtggctacaaggacgtcatcctgtggttctctttcggggcaagttgttttattctgctcgctattgtcatgggtctggtctttatctgtgtcaaaaatggcaacatgcggtgcacaatctgtatt

SEQ ID NO: 671 - DNA, 1680 bp, Influenza A virus
  misc_feature (1)..(1680): Codon Optimized Sequence Encoding H7 Hemagglutinin
atgaacacacagattctagtgtttgcactgattgctatcattcctacaaatgcagacaagatttgtctgggccatcacgccgtctcgaatggtacaaaagtgaataccctgactgaaagaggggtcgaagtggttaacgcaacagagaccgtagagagaacgaatattccaagaatctgctctaagggcaaaaaaacagtggatctgggtcagtgtggactgttagggacaatcacaggtccaccacaatgcgaccagttccttgaattctcggcggatcttatcatcgagcgccgagaaggttccgacgtgtgttacccaggaaaattcgtcaatgaggaggctttgagacagatcttgcgcgaaagcggtggcatcgacaaagaggctatgggattcacttactctggaatacgaactaacggtgccacgtccgcttgccgcaggagtggatctagcttctatgcagagatgaagtggctattgagcaacactgataatgctgccttccctcagatgacaaagagctataaaaacactagaaagagcccagcattgatcgtttggggcattcaccacagtgtatccacagcagagcagaccaaactgtatgggagtggaaacaagcttgttactgtagggtccagcaactatcaacagagctttgttccgtcaccaggtgctcggccccaggttaatgggcaaagtgggcggatcgacttccactggctgatgctcaatcctaatgacacggtcacattttcctttaacggggccttcattgctccggatcgcgccagctttctgcgtggaaagagtatgggtattcaaagtggcgttcaggtcgacgccaactgcgagggcgactgctatcatagcggtggaacaatcatctctaacctgcctttccagaacatcgatagcagagccgttggcaagtgtcccaggtacgtgaagcagcgatcactgttgttggctacgggcatgaaaaacgtcccagagattccaaaagggaggggactattcggcgccattgctgggttcattgaaaatggctgggagggtctgattgatggatggtacgggtttaggcaccaaaacgcccaaggcgaagggacagcagctgactataaatccactcaatctgctatcgaccagatcactggaaaactcaacagacttattgagaagactaatcagcagtttgagctcatcgacaacgagtttaatgaagtggagaagcagattgggaacgttatcaactggacgagggactcaatcacggaagtatggtcctacaatgccgaattgctggtggccatggagaaccagcacaccattgacctggcggactccgaaatggataaactctacgaacgagtgaagaggcaactccgagaaaatgctgaggaagatgggaccggttgtttcgagatctttcataagtgtgacgatgactgcatggcttctattagaaacaatacttacgatcactcaaaatatagagaagaggcaatgcagaaccgcattcagatcgacccggtgaagctgagcagtggttataaggatgtcattttatggtttagttttggagcatcttgttttattttgctcgctatcgtaatgggcctcgtgtttatctgcgtgaaaaatggtaacatgcggtgcacgatatgcatt

SEQ ID NO: 672 - DNA, 1680 bp, Influenza A virus
  misc_feature (1)..(1680): Codon Optimized Sequence Encoding H7 Hemagglutinin
atgaatacgcagattttggttttcgccttgattgccattattcctacaaacgccgacaagatctgcctgggacatcacgccgtgagtaatggaaccaaggtgaatacactgaccgagaggggcgtagaagttgtaaatgctactgagacagtggagcgaacaaatattcccagaatttgctccaagggcaagaagactgtcgaccttggccaatgtgggctgctcggcacgatcacggggccaccccaatgtgatcagtttctggagttttctgccgacctcattatagaacgccgggaggggagcgacgtatgctaccccggtaagttcgtaaacgaagaagccctcagacagattttgagggagtccggaggcatcgataaggaggcaatgggcttcacctacagcggcatcagaacaaacggtgccacaagtgcatgtaggcgctctggctcatcattctatgcagagatgaagtggctgctttccaatactgataatgcggcctttcctcagatgactaaatcatataagaacaccagaaaatctcccgccttgatcgtctgggggatccatcacagcgtctctaccgctgagcagaccaaactctacggttcagggaacaaattagtgaccgttggcagctccaactaccagcaatcatttgtgccttccccaggtgccaggccgcaagtaaacggtcagtcaggacgaattgatttccactggctaatgctgaacccgaatgacacagtcaccttcagctttaacggggctttcatcgcacccgaccgcgccagtttcttacggggaaaatcaatgggaatacaatccggcgttcaagtggacgcgaattgcgagggagattgttaccatagtggtggtacaattatctccaatcttccctttcagaatatcgacagtagggcagtgggaaaatgtccccgatacgtcaaacagcggagcctgctcctcgccaccgggatgaagaacgtccccgagattccaaaaggtaggggtttgttcggagctatcgcagggttcatcgaaaacggctgggaaggcctgatagacggttggtatggattccgacaccaaaacgctcaaggcgagggcactgcagcagattacaaatctacacaaagcgctatcgaccagattaccggaaaacttaaccgtctaatcgaaaagaccaatcagcagttcgagctcatcgataacgaattcaatgaggtggagaaacagatcggaaacgtaatcaattggacacgagattccatcactgaggtttggtcttataacgccgaactcttagtggctatggagaatcagcacaccatcgacctggctgattccgagatggacaagctgtacgaaagagtgaagagacagcttcgcgaaaacgcagaggaggatgggaccggatgtttcgaaatcttccacaaatgtgatgatgattgcatggccagcatccggaacaacacatatgatcattcgaaatatcgcgaggaggctatgcaaaatcggatccagatcgatcccgtcaagctaagctctgggtacaaggacgtgattttatggttttccttcggcgcttcatgtttcatccttctggccatcgtgatgggcctagtgtttatctgcgtcaagaatggaaacatgagatgtacgatctgcatc

SEQ ID NO: 673 - DNA, 1680 bp, Influenza A virus
  misc_feature (1)..(1680): Codon Optimized Sequence Encoding H7 Hemagglutinin
atgaacactcagattctggtatttgcgctaatcgcaatcattcccaccaacgcagacaagatttgtctgggacatcatgccgtgagcaacggcacaaaagtgaacactctgactgaaaggggagtggaggttgtaaatgcgaccgaaactgtggaaagaaccaatataccccgaatctgtagcaagggtaaaaagaccgtagacttaggacagtgtggtctcttggggacaatcacaggcccccctcaatgtgaccagttcttagagtttagcgcagatttgattatcgagcgaagggagggaagtgacgtttgttaccctgggaagttcgtgaatgaagaagctctccgtcagatcttgagggagtccggaggcatagacaaagaggccatggggttcacttactccgggattcgcacaaatggagctacaagtgcctgtagaaggtcaggcagttctttctatgctgagatgaaatggctcttatcaaacacagacaacgctgccttcccacagatgacaaaatcctacaaaaacactcgcaaatccccagcccttatcgtgtgggggatccatcactccgtgtccactgcggaacagactaagctgtatggatccgggaacaaactggtaactgtagggagtagcaactaccagcagtccttcgtcccatctcctggggcacgcccccaggtaaacggacagtctggaagaattgatttccactggttgatgctgaacccaaatgatactgtgaccttctctttcaatggcgctttcatcgcgcccgatcgcgctagcttcctaaggggaaaatccatggggattcagtctggcgtccaggtcgatgcaaattgcgaaggcgactgttaccattctggagggaccattatcagtaacctgccattccagaatattgactcgagggcagtgggtaagtgccccaggtacgtgaaacaaagatcactgcttctggctacaggaatgaagaacgtacctgagatccctaaagggcggggattattcggagccatcgcaggcttcatagagaacgggtgggagggcctgattgatgggtggtacggattcaggcaccaaaatgcccagggagaagggaccgctgcggattacaagagtacccagtccgctatagaccagatcacaggcaaacttaataggctgattgaaaagaccaatcagcagtttgaactcatcgataacgaatttaacgaggtggaaaagcagattgggaacgtgattaactggacaagggattctattaccgaggtgtggagctacaatgccgagctgttggttgcgatggagaatcagcacactatcgatctagcagactccgaaatggacaagttgtatgaaagagtgaagcgccaattaagggaaaacgcagaggaggatgggaccggatgttttgagatcttccataaatgcgatgacgactgcatggccagcattagaaataatacctacgaccatagtaagtatagggaggaggcgatgcaaaacagaattcaaatagacccagtgaaactgagttctgggtacaaagacgttattctctggttttcattcggcgccagctgctttatactgctggctatcgtcatgggcttggtcttcatctgcgtgaaaaacgggaatatgcgatgcacaatttgtatt

SEQ ID NO: 674 - DNA, 1680 bp, Influenza A virus
  misc_feature (1)..(1680): Codon Optimized Sequence Encoding H7 Hemagglutinin
atgaatacccagatcctggtgttcgctctcatcgccatcataccaacaaacgctgacaagatctgcctaggtcaccacgctgtgtctaatggaaccaaagtgaatacactgaccgagcgcggtgtggaggtggtgaacgctacagagaccgtggaacgcactaatatccctcgaatatgttctaagggcaagaaaactgtagatctggggcagtgcggccttctgggaactatcacgggccctccacagtgcgatcaatttttggagttttctgccgacctcatcatcgaacgccgtgagggatcggacgtgtgttatccaggaaagtttgtgaatgaggaagcgctccggcagatcttaagagaaagcggtggtattgacaaagaagcaatgggcttcacctattcaggaattaggaccaacggagcaaccagtgcgtgtagacgaagcgggtcttcattctacgccgaaatgaagtggctgctttctaacaccgataacgcagcattcccacaaatgaccaagagctacaagaatacaagaaaatcccctgcattaattgtatggggaatccatcactccgtctcaacagcagaacagacaaaactttatggcagtggcaacaaactcgtcaccgttggtagctccaactaccagcagtctttcgtgccaagtcccggggcccgaccgcaagtgaacgggcagtctggcagaatcgactttcactggctcatgctgaatccaaacgacacagttaccttcagcttcaatggggcattcattgccccagacagagccagctttcttcgaggcaagagcatgggcatccagagcggggtacaggtcgacgcaaactgtgaaggagattgctaccactccggcgggacgatcatttcgaatctgccattccagaatatcgactctagggctgtggggaaatgtcctaggtatgtgaaacagcggagcctccttctggcaacaggaatgaaaaacgtacctgagatccctaaggggcgaggattgtttggtgccatcgcgggattcattgaaaatggctgggagggattgattgacggctggtacggattccggcatcaaaacgcgcaaggggagggtacggcggcagattacaaaagcactcagtccgcgatcgaccagatcaccggcaaactcaatagacttatcgagaagactaaccaacagttcgagctcatcgacaatgagtttaatgaagtagagaaacagatcggcaatgtcataaactggaccagggacagcatcaccgaagtgtggtcctataacgccgagctcctggtggccatggagaatcagcacactatagacttagctgactctgagatggacaagctctatgagagagttaaacggcagctcagagaaaacgcagaagaagatggcaccgggtgcttcgagatctttcataaatgtgatgacgactgcatggcctcgatacgtaacaatacatatgatcatagtaagtatcgggaggaagcaatgcagaacaggattcagatcgaccccgttaaattgtccagcggctataaggacgtaattctgtggttctcgtttggcgcctcctgtttcattttgttggccattgtgatgggtctcgtcttcatttgcgtaaaaaatggcaatatgcggtgcactatttgtatc

SEQ ID NO: 675 - DNA, 1680 bp, Influenza A virus
  misc_feature (1)..(1680): Codon Optimized Sequence Encoding H7 Hemagglutinin
atgaatactcagatcctagtttttgctctgattgccataattccgacgaatgcggacaagatttgcctgggacaccacgctgtcagtaacggtaccaaagtaaataccctgacggagcgaggtgtcgaggtggtgaatgccaccgaaactgtggagagaaccaacatccctcggatctgtagcaagggcaagaaaactgtggacctcggtcagtgtgggttgctcgggaccattacaggccccccacagtgcgatcaatttctggagttctctgccgacttaattattgaaagacgggagggtagcgacgtttgttatcccggcaaattcgtaaatgaggaggccttgcgccagattttgcgcgagtccggcggcattgataaagaggctatgggattcacttattctggcattaggacaaacggcgcgaccagtgcatgtcgccgatccggctcctccttttacgctgagatgaaatggctgttgtcgaacactgacaacgctgcatttccacagatgacaaagtcctataagaacaccaggaagagtccggccctgatcgtgtggggaatacatcactctgtgtccaccgccgaacagaccaagctgtacggaagtggcaataagctggttactgtcgggagcagcaattaccagcagagttttgtgccgtcacccggggcccggcctcaggtgaatggtcagtccggtagaatagacttccactggcttatgctaaacccaaatgacaccgttaccttctcatttaacggtgcctttattgcccccgaccgggcttcattcctgcgcgggaaatccatgggcatccaatctggggtgcaggttgacgctaattgtgagggagactgttatcatagcggaggcaccataatctccaatctgcccttccagaacattgacagcagagcagtaggcaaatgccccaggtatgtcaagcaacgaagccttcttctcgctaccggtatgaagaatgtgcccgaaataccaaagggacgggggctctttggcgcgatagccgggttcatcgagaatggatgggagggactcattgacggttggtatgggttccgccatcagaacgcgcagggggaaggcacagcagccgactataagtccacacagagtgcaattgaccaaattaccggcaaattaaacagactcattgagaagactaaccagcagtttgagttaattgataatgagtttaacgaagtggagaaacaaattggaaacgtgatcaactggacacgagatagcattacggaggtatggtcatataacgccgagctgctcgttgcgatggagaatcaacacacaattgatttagcagactccgaaatggacaaactttacgaacgggtgaaacgccagctgcgcgaaaacgctgaagaagatgggacaggttgctttgaaatttttcacaagtgcgatgatgactgcatggcctcaatccgtaataatacatacgatcacagcaagtatagggaagaagccatgcagaataggattcaaatagacccggtgaaattatcttctggctataaagatgttattctgtggttctccttcggcgcgtcatgtttcattttattggccattgtgatgggcctggttttcatatgcgtgaagaacggaaatatgagatgcaccatctgtatt

SEQ ID NO: 676 - DNA, 1680 bp, Influenza A virus
  misc_feature (1)..(1680): Codon Optimized Sequence Encoding H7 Hemagglutinin
atgaacacacaaatcctggtgtttgccttaatagctattatcccaaccaacgcagacaagatctgtcttggacaccatgctgtaagcaatggaaccaaagtgaacacattgaccgagcgtggggtcgaagtggttaacgccaccgagacagtggagaggactaatatccccagaatttgtagtaaagggaagaggacagttgacttaggacaatgcggactgttgggtaccattacaggtccaccccagtgtgatcagtttctggaattcagcgctgatttgatcatcgagcggagagaaggcagtgatgtctgttaccctgggaaattcgtcaacgaagaggcattgcgccagattttgagggaatccggcggaatcgacaaagaagccatggggttcacatactcagggatccggacgaatggcgcaacgagcgcttgtaggaggtccgggagttctttctatgcggagatgaaatggctattgagcaacacagataatgccgctttccctcaaatgaccaagtcatacaaaaatacaaggaagagcccagcccttatcgtgtggggtatccatcacagtgtgtctaccgcagaacagacaaaactctacggcagcgggaacaaacttgtgaccgtcggctcttcaaactatcaacagagtttcgttccgtctccaggcgcaaggccacaggtgaatggattaagtgggcggatcgattttcattggcttatgctcaaccctaatgatacagtcacattctcttttaatggagctttcattgccccagacagggcgtccttcctgcgaggcaaatctatgggtatacaaagcggcgtccaggtagacgcaaattgtgagggtgattgctaccacagcgggggaaccattatcagcaacttgccattccaaaacatcgattcccgtgctgtgggcaagtgtccaagatatgtgaaacagaggagtctgttgttggcgacgggaatgaaaaacgttcccgagattccaaagggccggggactttttggggccatcgccggattcatagagaacggctgggaaggactcattaatggatggtatgggttccggcatcagaacgctcagggggagggcaccgctgctgactacaagagtacccagtctgccatcgatcagattaccggtaagttgaataggctgatcgagaaaactaaccagcagtttgagctcattgataatgaattcaacgaggtagaaaaacagataggcaacgtgattaactggacccgtgactccataacggaggtatggagttataatgcagaactcctcgtggctatggaaaatcagcacacaattgatttagctgactcagaaatggataagctgtacgagcgggtcaaacgccaactgcgcgagaatgcagaagaagacgggaccgggtgtttcgaaatctttcataaatgcgacgatgactgtatggccagcatccgtaacaacacttacgaccacagcaagtatcgggaggaagctatgcaaaataggatccagatcgaccctgtcaaattatccagtgggtacaaagatgtcatcctgtggttttcctttggcgcgtcatgctttattttgttggctatcgtgatgggcctcgtttttatctgtgtgaagaatggaaacatgcgatgcaccatctgtatt

SEQ ID NO: 677 - DNA, 1680 bp, Influenza A virus
  misc_feature (1)..(1680): Codon Optimized Sequence Encoding H7 Hemagglutinin
atgaacactcagattctggtgttcgcactaatcgcaatcatacctactaatgccgacaaaatttgcctcggccaccatgccgtgtcaaatggcacaaaagtgaataccctgacggagcgcggcgtcgaggttgtcaatgccacagagacagtggaacggaccaacattccacgtatttgttcaaaaggcaagcgtaccgttgacctgggtcagtgcggacttctcgggacaatcactggaccaccacagtgcgatcagttcttggagttttcagcagaccttatcatcgagaggcgggaaggtagcgacgtttgctaccccggcaaatttgttaatgaagaagccttaaggcagatcctacgagaatcagggggcattgacaaagaagcgatgggattcacttacagtggaattagaacaaacggtgccacgtctgcttgcagacgctcgggctctagcttttatgctgaaatgaaatggttgctgagcaataccgataatgctgccttcccacagatgacaaaaagttacaagaatactagaaagtcacccgcactgatcgtctgggggattcaccattcagtcagcaccgccgagcagaccaaactttatggtagcggtaacaagttagtgacagttggaagctccaattatcaacagtcatttgtgccatctcccggggctcgaccccaagtgaacgggttaagtggtcggatcgacttccactggttgatgctcaaccctaacgacacagtcacattctccttcaacggcgcattcatagcccccgaccgggcaagcttcctaaggggaaagagtatgggaatccagtctggggtgcaagttgatgccaactgcgaaggggattgctatcattccggcgggacaattataagcaacctgccattccagaacatcgattcacgggcagtcgggaagtgccccaggtatgtgaagcagcggtcactgctgttggctactggcatgaaaaacgtgccggagatcccaaaaggccgtgggctcttcggggctatcgccgggtttatcgagaacggctgggagggcctgattaatgggtggtatggctttaggcatcagaacgcgcaaggagagggaaccgcggccgactataagagcacacagtctgcgatcgatcaaataaccggtaagctcaatcggctgattgaaaaaaccaaccagcagtttgagctaatcgacaatgaattcaacgaggtggaaaagcagattggtaacgtcattaattggacaagagacagtattactgaggtgtggagttataacgctgaactgctggttgccatggagaatcagcacactattgacctggcagattctgagatggataagctctatgagagagtgaaacggcagctgagagagaatgctgaagaggatggaaccgggtgcttcgaaatttttcataagtgtgatgacgattgtatggcctcgattagaaataatacatacgatcactccaagtaccgagaggaggccatgcagaacaggatccaaattgacccggttaagctgagtagtggctacaaggatgttatattatggtttagcttcggagcctcctgcttcatactgctggctattgtgatggggttagtctttatctgcgtgaaaaatgggaacatgagatgtacaatctgtata

SEQ ID NO: 678 - DNA, 1680 bp, Influenza A virus
  misc_feature (1)..(1680): Codon Optimized Sequence Encoding H7 Hemagglutinin
atgaacacgcagatcctagtctttgcccttattgccataatccctaccaacgccgataagatctgcctcggtcaccacgccgtttccaatggcacaaaggtgaatactttgacagaacggggggttgaggtggtcaatgctaccgaaaccgtagagcgaacaaatatcccgagaatatgttccaaaggcaagaagaccgtggacctcggacagtgtggattactcgggacaatcacaggtcccccacagtgcgatcagttcttggaattctctgccgacctcattatcgaacggagagaaggatcggatgtgtgttatcctggcaagttcgtcaatgaggaagctcttagacagatcttacgcgagagtggtggcatcgacaaggaagcaatgggtttcacatatagcggaattcggactaatggagcaacttcagcttgtaggagaagcggctcatctttttatgccgaaatgaagtggctgttatctaacaccgataacgctgccttcccacagatgacgaaatcatacaagaacactaggaagagcccagctctgattgtgtggggtattcatcatagtgtctccacggcggaacagactaagctgtatgggtccggcaataaacttgtcaccgtaggcagcagcaactaccagcagagcttcgtgcctagcccaggagctaggccccaggtgaatggacagtctgggcgaatagacttccactggcttatgctcaatccgaatgacacagtgacattcagcttcaatggggcttttattgctccagacagagccagcttcctgagaggcaaatcaatggggatccaaagcggagtacaggttgacgccaactgtgaaggcgattgctaccactcagggggcacaattatctctaacctgccattccagaatattgattcgagagctgtggggaagtgtcctaggtatgtaaaacagcggagcctgctcctcgctacagggatgaagaatgtcccggaaatcccaaaaggacggggcctgtttggcgcaattgccggcttcatagagaatgggtgggagggactgatcgatggatggtacgggtttcgccaccagaacgcccagggagaagggacagccgctgattacaaatccacacaaagcgcaatcgaccagatcacaggtaaactgaataggctcatcgagaagaccaatcagcaattcgaacttatcgacaatgagtttaatgaggtggagaaacaaatcggaaatgtgatcaattggacgcgagattctattactgaggtgtggtcatacaatgccgaactccttgtggctatggaaaatcagcacaccatagacctggccgactccgagatggataagctatacgagcgcgtcaagcgccagctgagggaaaatgctgaggaagacggaacgggttgcttcgaaatttttcacaagtgcgacgatgactgcatggcctctattagaaataatacatacgaccactctaagtatagggaagaggccatgcagaatcgcatacagatcgatcctgtgaaactctccagcgggtataaggatgtcattctgtggttcagtttcggcgctagctgttttatacttttggctattgttatgggtctagtgtttatttgcgtgaaaaacggcaatatgcggtgcacaatatgcatt

SEQ ID NO: 679 - DNA, 1680 bp, Influenza A virus
  misc_feature (1)..(1680): Codon Optimized Sequence Encoding H7 Hemagglutinin
atgaatacccagatccttgtcttcgcattaatagcaatcattccaaccaatgctgacaagatctgtctgggtcaccatgcagtttccaatggcacaaaagttaatacactgacagaacgcggggtggaagtagtcaacgccaccgaaaccgtagagaggaccaatatccccaggatctgctcaaagggaaagcgtacagtggacctgggacagtgtgggctgctcggcacaattacaggaccaccacagtgtgaccagttcctggagtttagcgctgacttaataatcgagagaagagagggaagcgacgtctgttatcctggcaagtttgtcaaggaggaggctcttaggcagatcttgagagagtcgggcggcatagataaagaggcaatgggattcacctattcagggattaggaccaatggtgccacaagtgcctgcagaagatcaggctctagtttttacgctgagatgaagtggcttctgtcgaacacagataacgccgcgttccctcagatgactaagtcatacaaaaatacacgcaaaagtcctgccttaatcgtgtgggggatacatcatagtgtatccaccgccgagcagactaagctctacggtagcggtaataagctggtcactgtgggcagttccaactaccagcagagttttgttcccagccccggtgctcgtccccaagtgaacggacttagcggtaggattgactttcattggctgatgttgaatcctaatgacacggtcacttttagtttcaacggcgctttcatcgctcccgatagagcttccttcttgcgcggaaagagtatggggatacagtcaggcgtgcaggtcgacgcgaattgtgaaggggattgctaccatagtggaggcactattatctcaaacctccctttccagaacatcgacagtagggccgtgggaaaatgccctaggtacgttaagcagagatccctattgctggccacgggtatgaagaatgtccccgaaattccaaaaggaagaggactgttcggcgccatcgctggctttatcgagaacgggtgggaggggctcatcgacgggtggtacgggttcagacaccagaatgcccaaggggagggcaccgccgctgactacaaatctacgcaaagtgccattgaccagattaccggaaagctcaaccggctgattgagaagaccaaccagcaatttgagctaattgacaatgaatttaacgaggtcgagaagcaaattgggaacgtcataaactggactagggattcaattaccgaagtctggagctataacgcagaactattggtcgctatggagaaccagcacacaatcgatctcgctgattctgagatggataagctgtatgagagggtgaagagacagttgagggagaatgctgaggaggatggtaccggctgttttgaaatctttcataagtgtgacgatgactgtatggcttcaatccggaacaatacgtacgatcacagtaaatatagggaagaagctatgcagaacagaattcagattgatcctgtgaaactaagcagtggttataaagatgtgatcctctggttcagtttcggcgccagctgtttcatcctgctcgccatcgtaatgggactggtcttcatatgcgtgaagaatggaaacatgcgttgcaccatctgtatt

SEQ ID NO: 680 - DNA, 1680 bp, Influenza A virus
  misc_feature (1)..(1680): Codon Optimized Sequence Encoding H7 Hemagglutinin
atgaatacacagattctggtgttcgctttgatagcgatcattccaacaaatgcagacaagatctgcctcggtcatcacgcggtttcaaatggcaccaaagtgaacactctcaccgaacggggggtcgaggtagttaacgcgaccgagactgtggagcgtactaatatccccaggatctgttcaaagggaaagagaactgtggaccttgggcagtgtggtctgctgggcaccatcactggccccccccagtgtgaccagttcctggagttctcagccgaccttataattgagcgacgcgaaggatctgatgtatgctacccaggcaagtttgtgaaagaggaggcgttacgccagattctgagagagtctggtgggatcgacaaagaagcgatgggtttcacatacagcgggatccggaccaacggtgccacctcggcatgtcgtcgtagcggctcatccttctacgccgagatgaaatggctgctgtcaaacaccgacaacgccgctttcccgcagatgactaagagctacaaaaacaccagaaagtcacccgccctgattgtgtggggaattcatcactctgtgtctaccgccgaacagaccaaattgtatggttcggggaataagctggttacggtaggatcgtcaaattaccaacaaagctttgtgccctctccaggagccagacctcaggtaaacggcctctcaggaaggattgacttccactggctgatgctgaatcccaatgataccgtaacattctcatttaatggcgcgttcatcgcaccggatagggcatccttcttaagggggaagagtatgggcatccagtccggggttcaagtggatgccaattgcgaaggcgattgttaccactccggaggaacgattattagcaatctgcccttccaaaacatcgactctagggccgtgggcaaatgccctagatatgtgaagcagaggtccctgctcctagcgactggcatgaagaatgtgcccgagataccaaaagggagaggactattcggtgccatcgccgggttcattgaaaacggatgggaaggcctcatcgatgggtggtacggatttcggcaccagaatgcgcaaggggaaggtactgctgctgattataagagcactcagagcgctattgatcagattaccggtaaattgaaccgtctcattgaaaagacgaaccagcagttcgagctgatcgataatgagtttaatgaagtggaaaagcaaatcgggaacgtgatcaactggacaagagactcaatcactgaagtctggtcctacaatgccgagcttttggttgccatggagaaccagcatacgatcgaccttgccgatagcgagatggacaaactatacgagcgagtcaagaggcaactcagagaaaatgcagaagaggatggaaccggctgtttcgagatctttcataagtgcgacgacgattgcatggcttccattagaaataacacctacgaccactctaagtatagagaggaggctatgcaaaatcgcatccagattgatccggtgaaactctcctcggggtacaaagatgtgatcctgtggttctcctttggcgcaagctgtttcattttattagctattgtgatggggctcgtctttatctgcgtgaagaatggcaacatgcggtgtaccatctgtata

SEQ ID NO: 681 - DNA, 1680 bp, Influenza A virus
  misc_feature (1)..(1680): Codon Optimized Sequence Encoding H7 Hemagglutinin
atgaacactcagatactcgtctttgcgctcatcgctattattcctaccaacgcggataaaatttgcctcgggcaccacgcagtgtccaacggaactaaagtgaacacgctgactgaacgtggtgtggaagtggtgaacgcaacagaaacagtggaaaggactaatattccgcgtatatgcagtaagggtaagaagacggtcgacctggggcagtgcgggcttctcggtaccatcacgggtcctcctcagtgtgatcagttccttgagttttcagccgacctcatcattgaacgtcgtgagggaagtgatgtttgttatcccgggaagttcgtgaacgaagaggcattgagacagattctgcgggagtctgggggaatcgataaggaggccatgggtttcacatactccggtatcaggactaacggcgcaacctccgcctgccggcgaagcggcagctctttctacgctgaaatgaagtggctgttgtctaacaccgataacgccgctttccctcagatgaccaaatcctataagaatacgagaaagtctcctgctctcatcgtatgggggatccaccatagtgtgtctaccgccgagcagaccaaactgtacggctcaggcaacaaattggtgactgtagggagcagtaattatcagcaaagcttcgttccttcccctggagccagacctcaggtgaatggacagtcagggcggatcgatttccattggctgatgctgaacccaaacgatacagtgacattctcattcaatggcgcgttcatagccccagatcgcgcctctttcctgcgcgggaaatcaatgggcattcaatctggggtacaggtggacgctaactgtgagggggactgctatcattccgggggcacaattattagtaacctccctttccagaacattgattccagagccgtgggtaagtgcccgcggtacgtgaagcagaggtcactgctgctagccaccggaatgaaaaatgtgcctgaaatcccaaaaggacggggcttattcggcgctattgctggcttcatcgaaaatgggtgggaggggttgatcgacggttggtacgggttccgccaccagaacgctcagggcgaaggaaccgccgctgactataagtccacccagtctgccatcgaccagatcacaggaaaactgaataggctgatagaaaaaaccaatcagcagttcgaactgattgacaacgagttcaacgaggtcgagaaacagatcggaaatgttattaattggacccgagatagcatcactgaagtctggtcctataacgctgagcttctagtagcgatggaaaatcagcacacgatcgacctggcagatagcgaaatggacaaactctacgagagagtgaagcgccagcttcgagaaaacgccgaagaagatggaactgggtgctttgaaattttccacaagtgtgatgacgattgcatggcctctatccgcaataatacctacgatcacagtaaatatcgcgaagaagcgatgcaaaatcgtatccagatcgatcctgtaaagctcagctccggatacaaagacgtgattctctggttcagttttggcgccagctgttttatcctgctcgccatagtcatgggtttggtatttatctgcgtcaagaacgggaacatgcgttgcacaatctgcata

SEQ ID NO: 682 - DNA, 1680 bp, Influenza A virus
  misc_feature (1)..(1680): Codon Optimized Sequence Encoding H7 Hemagglutinin
atgaatactcaaatcctggtattcgccctaattgcaatcattccaaccaacgctgacaagatctgtttaggccaccacgccgtttcgaacggtacaaaggtgaataccctgacagagaggggcgtggaagtggtgaacgcgacagagaccgtggaacggaccaatatcccccgcatttgctccaagggaaaaaaaactgtagacctcggacagtgcggcctgctcggaacgatcaccggaccccctcagtgcgaccaatttctggaatttagtgcagatctcattattgagaggcgggaaggaagtgacgtttgctatcccggcaaatttgtgaatgaagaggcccttcgccagatcctcagagaaagcgggggcatagacaaagaggccatgggctttacctattctggcattcgaaccaacggcgctaccagtgcttgcagacggagcggctcgtccttctacgcagagatgaagtggcttttgtccaataccgacaacgctgctttccctcagatgaccaagtcttacaagaacacccgaaagtctccagcgctgattgtgtgggggattcatcactcagtgagtacagcagagcagactaagctgtatggatccggcaataaactcgtgactgtaggttcctcaaattatcaacagagctttgtcccctctccaggagccaggccccaggtgaacggacaatctgggcgtatagattttcactggctgatgttaaatccaaacgacaccgtaaccttctcgtttaatggagcctttatcgctcctgacagagcgagctttttaagaggaaaaagtatgggaatacagtccggagttcaggtggatgccaactgtgagggtgattgctaccacagtggcggtacaattatcagtaatctacccttccaaaatatcgattctcgggcagtgggcaagtgtccccgctatgtcaagcagcggagccttctcttggcaacaggtatgaaaaacgtgcctgaaatccctaaaggaaggggcctgttcggtgccattgcaggatttatcgagaatgggtgggaagggcttattgacgggtggtatggattccggcaccagaatgcccagggggaaggcaccgccgctgactacaaatctacacagagtgccattgatcagatcacgggcaaactcaacagacttatcgagaagacaaatcagcaatttgagctgatagacaatgagttcaatgaagtggaaaaacagatcgggaatgtgattaactggaccagagattccatcacagaggtctggtcctataacgccgaactgctcgttgccatggaaaaccagcataccatcgatcttgccgattccgagatggacaagctctatgaacgcgtcaagcgacagctcagagaaaatgcagaggaggatgggacaggatgttttgaaattttccacaagtgcgatgacgactgtatggcatccattcgcaacaacacatacgatcacagcaagtatagagaggaggccatgcagaacagaatacagatcgatccagttaaactgagttctggctataaggatgtgattctctggttctctttcggagccagctgctttatcctgctggctatcgtcatgggcctggtgttcatctgcgtcaagaatggaaacatgcggtgcacgatttgcatt

SEQ ID NO: 683 - DNA, 1680 bp, Influenza A virus
  misc_feature (1)..(1680): Codon Optimized Sequence Encoding H7 Hemagglutinin
atgaatactcagatccttgtgttcgccttaatcgccatcatccctactaacgccgacaagatctgcctgggccaccacgctgtttccaatggcacgaaggtcaacactctcaccgaaagaggggttgaggtggtgaacgccaccgaaacagtagagagaacgaacatcccccgtatttgctccaaggggaaacgcactgtggatttaggacagtgcggcctgctggggacaattaccggacctcctcagtgcgaccaattcctggaattttcagctgacctcatcatagagcggcgagaggggtccgatgtatgctaccctggaaagtttgtgaatgaagaggcccttcggcagatcctgcgcgagagcggggggattgataaggaagccatgggttttacctattccggaattagaacgaacggcgctacatcagcttgccgccgttcaggttccagcttctatgccgagatgaagtggctactttccaataccgacaatgcggcattccctcagatgactaagtcttacaagaatactcggaagtcaccagcccttatcgtctggggcattcaccacagcgtgtcaaccgcggagcaaaccaaactatatgggtcggggtctaaactcgtaaccgtgggttcgagcaattaccagcagagcttcgttcccagtcctggcgctcgacctcaggtgaatgggctgagtgggaggatagactttcattggttaatgttaaatcctaacgatactgtcaccttctccttcaatggtgctttcattgcaccagaccgtgctagcttcctccgcgggaaatcgatgggcatacagtccggagtgcaagtcgacgctaactgtgaaggcgattgttaccattcaggcggcaccataatcagcaatctgccttttcagaacattgatagtcgtgctgtgggaaagtgtcctagatacgtgaagcagaggagtcttcttttggccactggcatgaaaaacgtaccagagatccccaaaggacggggcctgtttggcgctatcgcgggctttatagaaaatggctgggagggattaatcgacggctggtacggttttaggcaccagaatgcccaaggcgaaggtacagcagccgattacaaaagtacacagtccgccatcgatcagattaccgggaaactcaatcgtctcattgagaagacaaaccaacagtttgagcttatagacaacgaatttaatgaagtggagaaacagattggaaacgtaatcaactggacacgggactccataactgaggtctggagctacaatgctgaactcttggtggccatggagaaccagcataccattgacttggcagactctgagatggataagctgtacgaaagggtgaaacggcagcttcgtgaaaatgccgaggaggatggcaccggatgttttgagatattccacaagtgtgatgacgactgcatggcgagcattcgtaacaatacttacgatcactcaaagtaccgggaggaagccatgcagaatagaatccagatcgatcctgtgaagctgtcctcgggctacaaggacgtcatcctgtggttctcctttggcgctagctgtttcattctgttggcgatcgttatgggtctcgtctttatttgcgttaagaacggcaacatgcgttgcacaatttgcatt

SEQ ID NO: 684 - DNA, 1680 bp, Influenza A virus
  misc_feature (1)..(1680): Codon Optimized Sequence Encoding H7 Hemagglutinin
atgaatactcaaattctcgtctttgccctgattgctatcattcccaccaatgcagacaagatttgcctcggtcaccacgccgtatcaaacggcacaaaagtgaacacactgaccgaaagaggtgtcgaggtcgttaatgccactgagaccgttgagcggactaacatccctagaatctgcagcaaggggaagaaaactgtggatcttgggcagtgcggactgctgggaacaataaccgggcctccccaatgcgaccaattcctggagttttccgctgatctcattattgagcgcagagaagggagcgatgtatgctaccccggaaagtttgtcaacgaggaagctttgcgccagattctgagggaatctggcggcatcgacaaagaggctatgggattcacatacagtggtataaggactaatggagcaaccagcgcttgtcggcggtcggggagctccttttatgctgaaatgaaatggctgctttctaacactgataacgctgccttcccccagatgactaaatcgtacaagaacacacgaaaatcgccggcactgatcgtgtggggaatacaccattcagtgtccactgccgaacagaccaaactgtatggcagcggcaacaagctcgtgaccgttggttcctcgaactatcagcaaagcttcgtgccttcgccaggtgctcgccctcaggtcaatggacagtccggaaggattgactttcactggcttatgttgaacccgaacgatactgttacatttagttttaacggcgcctttattgcacccgacagggcctcatttttgcgaggcaagtcgatgggcatacaatctggcgtgcaggtagatgcaaactgtgaaggcgattgctatcactccggaggcacaattattagtaatctacccttccagaatatcgactctcgggcggtcggcaaatgtccccgatacgtaaagcaacgctccctgttgctggccactggtatgaagaacgtccctgaaatccccaaaggccggggattgttcggcgccatagcaggattcatcgagaacggctgggaaggtctcatagatggttggtatggtttccgtcaccagaacgcccagggggaaggcaccgcagcggattacaagtcgacgcagtctgcaatcgaccagatcaccggtaaactgaaccgcctgattgagaaaacaaaccaacaattcgaattaattgacaatgagtttaatgaggtagagaaacagattggcaacgtgattaactggacaagggattcaattaccgaagtttggagctacaacgccgagttgctggtcgctatggaaaaccagcacacaatcgacctggccgactccgagatggacaagttatatgaacgggtgaaacggcagctgcgggagaatgccgaggaggatggtacagggtgttttgaaatctttcacaaatgtgatgatgattgcatggcgtcaatacgcaacaacacatatgaccactcaaaatatcgagaagaagccatgcagaacagaatacagattgaccccgtgaagctttcaagtggctataaagatgtcattctgtggttctccttcggggcatcctgctttatcctgctcgccatcgttatggggcttgtgttcatttgtgtcaagaatggaaacatgaggtgcaccatctgcatc

SEQ ID NO: 685 - DNA, 1680 bp, Influenza A virus
  misc_feature (1)..(1680): Codon Optimized Sequence Encoding H7 Hemagglutinin
atgaatacccagatcctggtttttgccctgatcgctatcataccaacaaacgctgacaagatctgtcttggccaccacgctgtctctaatgggaccaaagtcaataccctgaccgaaaggggagtggaggtagtcaacgctactgagacagtcgaaagaactaatattcctagaatttgcagtaagggcaagaaaaccgtggatctggggcagtgtggcctgctgggcaccataaccgggcctcctcagtgcgatcagttcctggagttttccgccgatctgatcattgaacgcagggaaggcagcgacgtatgctacccagggaagtttgttaatgaggaagcactccgccagattctccgagagtctgggggtattgataaggaggcaatgggttttacatacagcggcattaggactaatggggctacttcagcttgccgaaggagcggatcttccttttacgctgagatgaaatggctcctgagcaataccgacaatgccgcctttcctcagatgacgaaatcttataagaacacaagaaagtccccagcactgatcgtgtgggggattcaccactcagtctccacagccgagcagaccaagctgtacggctcaggcaataaactcgtgacggttggcagctccaattaccagcagtcctttgtccctagtcctggagcccggcctcaggtgaatgggcagtccggtcgaatagactttcactggctcatgttaaaccccaatgacacagtgaccttcagcttcaatggggctttcatcgcccccgaccgtgccagctttctgcgggggaaaagcatggggatacagtctggggttcaggtggatgccaattgtgaaggggactgttaccactctgggggcaccatcatcagtaatttaccattccagaatattgactcgagagccgtaggaaagtgccccaggtacgtgaagcagagatctctgctgcttgcgacgggtatgaaaaatgtcccagagatcccgaaaggccggggactttttggagcaatcgccggcttcatcgagaatggctgggaagggctgatcgacggctggtacggctttcgccaccagaacgcccagggcgagggtacagcggcagactataagtccactcagagtgccatcgatcagatcacaggtaagctcaatcgtctcattgagaagaccaatcagcagttcgagctcatcgacaacgaattcaacgaggttgagaaacagatcggcaacgtgatcaactggacaagggacagtatcaccgaggtgtggagctacaacgctgagctgctggtggctatggaaaaccagcacaccatcgatctggcagattccgaaatggataagctttatgagcgggtgaagcgtcaactgagagagaacgccgaggaggatggaactggctgcttcgaaatctttcataaatgtgatgacgactgcatggcctcaatccggaataacacttatgaccacagcaaatacagagaagaggcgatgcagaatcgaatccagatagaccccgtcaagctttcatcgggttataaggacgttatcctatggttttcttttggcgccagctgctttatcctcctcgcgattgtcatgggacttgtgttcatttgcgtgaaaaacggcaatatgcgctgtacaatttgtatc

SEQ ID NO: 686 - DNA, 1680 bp, Influenza A virus
  misc_feature (1)..(1680): Codon Optimized Sequence Encoding H7 Hemagglutinin
atgaacacacagattctggttttcgccttgattgccattattcctactaatgcagacaagatctgtttgggccatcacgccgtaagtaacggtacgaaggtcaacaccttgacagagcgcggggttgaggttgtcaatgcaacagaaaccgtcgaacggacaaacatcccaaggatctgctcaaaaggcaagaaaaccgtcgacctggggcaatgtggccttctcggaactataaccggacccccacaatgcgatcaatttctggagttcagcgctgacctaataatagagagacgggaggggtcagatgtgtgttatccggggaaattcgtgaacgaagaagcccttaggcagatcttacgggaaagcggtggcatcgacaaagaggccatgggatttacctacagcgggatccggacgaacggtgccactagtgcatgtcggaggtcgggaagctctttttacgccgagatgaagtggcttctgagcaatacagataatgctgctttcccgcagatgacaaagtcttacaagaatacaagaaaatccccagctctcatagtctggggtatccatcattctgtatccacggccgagcaaaccaaactttacggctctgggaataaactggtgacagtgggatcatctaattatcagcagtctttcgtgccatcaccaggcgcacgaccgcaagttaacggacagtctggtagaatcgactttcattggctaatgctgaacccgaatgatactgtgaccttcagtttcaatggggctttcatagcaccagacagggcatcatttctcagaggaaaatcaatgggcattcagtctggtgtgcaggtggatgcaaattgcgagggagactgctatcacagtggcggcactatcatctcgaatctcccgttccagaatatcgatagccgcgccgtggggaagtgccctcggtacgttaaacaacgatctctgctgttagccaccggcatgaagaatgtacccgagatccctaagggtcgaggcctctttggcgccattgctggctttatcgagaatggctgggaaggactcatagacggctggtatgggttccggcatcagaacgctcagggagaagggaccgctgcggactataagtcaacacagtccgccattgaccaaatcacaggcaagctgaaccggctgattgaaaaaactaatcaacaattcgagctgatagataacgagttcaacgaagtcgaaaagcagattggcaatgtcattaattggacacgcgatagcatcactgaagtgtggagctacaacgcagagctgctggttgccatggagaaccagcacaccatcgatctggctgactctgagatggacaagctgtacgaacgggtgaagcgtcagctccgtgagaacgctgaagaagatgggacaggttgcttcgaaatctttcataaatgcgacgacgattgtatggcctcaataaggaacaatacatatgaccactctaagtatagagaggaggccatgcagaatcgtatccagatcgatccagtgaagctgtcttcagggtacaaagatgtgatcctctggttttcattcggtgccagctgttttatcttactggccatcgtcatgggcctcgtcttcatttgtgtgaaaaacggtaacatgagatgcaccatttgtatt

SEQ ID NO: 687 - DNA, 1680 bp, Influenza A virus
  misc_feature (1)..(1680): Codon Optimized Sequence Encoding H7 Hemagglutinin
atgaatacgcagattttggtgttcgccctgatcgccataatccccactaacgccgacaaaatctgtctggggcaccacgcggtgtctaatgggactaaggtaaacacactgacagagagaggcgttgaggttgttaacgccacggagacagtagaacgtacaaacatcccccgcatctgctccaagggcaaaaagactgtggatctggggcagtgcggtttgctcggaaccattacaggcccccctcagtgtgaccaatttcttgaattctccgccgacctcatcatcgagcgccgggaaggaagtgatgtttgctatcccgggaaatttgtgaatgaggaagccctgaggcaaattctccgggagtcagggggtattgacaaagaggctatggggtttacatactccggtatccgtaccaatggagcaacctcggcttgccgtaggtccggcagctccttttacgctgagatgaaatggctgctctcgaacaccgacaatgccgcatttccccagatgactaagtcttacaagaatacccggaagtctccggccctgattgtgtggggaatccaccattccgtgtccaccgccgaacagactaagctttacggctcgggcaacaaactggtcaccgttggctcttctaactatcagcagagctttgtgccttcaccaggggctcgacctcaggtgaacgggcagtccggccggatcgatttccactggctaatgctgaacccaaatgatactgttacgttttccttcaatggtgcttttatagcacctgatcgcgcttcctttctgagggggaaaagcatgggcatacaatctggggttcaggttgatgccaactgtgagggggattgctatcactctggtgggaccataatttccaacctcccctttcagaacatcgactcacgagccgtcggtaagtgtccaagatacgtgaagcaacgctcattactcctggctaccggaatgaaaaatgttccagagatcccgaaggggaggggtctgttcggtgccattgcgggatttattgaaaacggatgggagggactaatcgacggatggtatgggtttaggcatcagaacgcacagggcgagggaaccgccgcggactataaaagcactcagtccgccattgatcagattacagggaaactcaatagactcattgagaagacgaatcagcagttcgagctgatcgacaacgagttcaatgaggtcgaaaaacagatcgggaatgtgataaattggactagggattcaataacagaggtctggagctacaacgcagagttactcgttgcgatggagaaccaacatactattgatcttgcagactccgagatggataagctatacgagcgggtcaagcgacagttaagggagaatgcagaagaagatggaactgggtgcttcgaaatatttcataagtgcgacgacgactgtatggcctcaatccgcaacaacacatacgaccactcaaagtacagggaggaagccatgcagaaccggatccaaattgacccggtgaaactgagctctggctacaaggacgtgatcctatggttttcttttggggccagttgcttcatcctactcgctatagtcatgggtctggtgttcatttgtgtcaagaacgggaacatgcgttgtactatctgcatt

SEQ ID NO: 688 - DNA, 1680 bp, Influenza A virus
  misc_feature (1)..(1680): Codon Optimized Sequence Encoding H7 Hemagglutinin
atgaatacccaaatcttggtgttcgcgttgatcgcaatcatccccactaacgccgacaaaatctgtttagggcatcacgctgtttccaacggtacgaaagtgaatacactgactgaacgcggggtcgaggtcgttaacgctacagagacggtggagagaactaatatccctaggatctgctccaagggcaagcgcactgtggacctggggcaatgcggactgctagggacaattactggcccgccccagtgcgaccaatttttggagtttagcgcagacctgatcatagagcgacgcgagggttcagacgtttgttaccctggaaagtttgtaaatgaggaagcccttcgccagatcctgcgggagagcggcggtatcgataaagaggctatggggtttacgtactctggaatcagaaccaatggggccacctctgcttgtagaagatctggatcctccttttatgcagaaatgaagtggttgttatcaaatactgataacgcggcatttccacagatgactaagagctacaagaacacgcggaagtcacccgctttaatagtctggggcatccaccactcagttagtacagctgagcagactaagctgtatggcagtggtaacaagctggtcaccgtgggtagctctaattatcagcaatctttcgtaccatcacccggagctagacctcaggtgaacggtctgtcaggccggatcgacttccactggttgatgctcaatcccaatgacactgttacattcagctttaatggcgccttcatcgctcctgaccgagccagctttctgcgcggcaagtctatggggatccaatctggcgtgcaggttgatgcgaactgcgaaggggactgctaccacagtggaggcaccatcatttctaacctgccattccagaatatcgacagtcgcgccgtggggaagtgtcctcgatacgtgaagcagaggagcctcctcctagcgactggaatgaagaacgtcccagaaatccctaagggccgggggctctttggagcgattgccggatttatcgaaaacggctgggaagggcttattaatggctggtacggcttcaggcatcagaatgctcaaggcgagggaactgccgccgactacaagtccactcaatccgccattgatcagataaccgggaaacttaaccgcctgatcgagaagacaaaccagcagtttgagctgatagataatgagttcaatgaagtcgagaaacagataggaaacgtcattaattggacccgcgactcaattacagaagtctggagctataacgcagagctgttggtagcgatggaaaaccaacacacaattgacctggccgattccgaaatggataagctgtacgagcgcgtgaaaagacagttaagggaaaatgccgaggaagatggtaccggctgtttcgagatcttccacaagtgcgatgatgattgcatggcctccatccgaaataatacttacgatcactccaagtacagagaggaggcaatgcaaaacagaattcagatcgaccccgttaagttatcaagcggatacaaggacgtcatcctgtggttctcatttggcgcatcgtgttttattctgcttgctattgtgatgggtctcgttttcatttgtgtcaagaacgggaatatgaggtgtacgatctgcatc

SEQ ID NO: 689 - DNA, 1680 bp, Influenza A virus
  misc_feature (1)..(1680): Codon Optimized Sequence Encoding H7 Hemagglutinin
atgaacacccagattttagtctttgcactgattgcaattattcccactaatgctgacaagatctgtctgggccaccacgctgtgtcaaacggaactaaggtgaacacgctgactgagcgaggtgtcgaagtggtgaatgcgacggaaaccgtggagagaacaaatatccccagaatctgcagtaaaggaaaaaaaactgtggatctgggccaatgcgggctgctgggtactatcaccgggccaccacaatgcgaccagtttcttgagttctccgcagatctcatcatcgaacgccgggaaggctccgatgtttgttacccagggaagttcgtaaatgaagaagccttaaggcaaatccttagagagagcggaggaattgagaaagaggcaatgggctttacctactcaggaattagagccaacggcgctacttccgcttgtcgacgaagtggctccagtttctatgccgaaatgaagtggctgttgtctaacacggataacgcagcctttcctcagatgactaagtcgtacaaaaacacccggaaatctccagctctgattgtgtggggaatccaccatagtgtgtccaccgccgagcaaaccaaactttatgggagcggaaacaagttggttactgttggatcctcgaactatcagcagagcttcgtgcctagcccaggcgctcgtccacaggtgaacggactctccggtagaatcgattttcattggcttatgctcaatcctaatgacactgtgacctttagcttcaacggcgcgtttatcgcccctgatcgagcctctttcctgcgcggaaagtcaatgggtatccagtcgggcgttcaggtggatgcaaattgcgagggggactgctatcactctggtggcaccattatctcaaacctgccatttcagaacatcgactcccgtgcggtcggtaaatgcccgagatacgttaagcagcgaagcctgctactggcaacaggcatgaagaacgtgcctgagatacctaagggacgtggtctgtttggagcaattgccgggttcattgagaatggctgggaggggctcatcgatgggtggtatggctttagacatcaaaatgctcagggagaaggtactgcagccgattacaagagtacccagagcgccatcgatcagatcactggcaagttaaaccgccttatcgaaaagaccaaccagcagtttgagcttatcgacaatgaatttaacgaagtggagaagcaaatcggcaacgtcatcaactggactcgcgattctatcaccgaggtctggtcatataacgcagagttactcgttgcgatggaaaaccagcacactattgacttggccgactctgagatggacaaactgtacgaaagagttaaaagacagctgcgggaaaacgctgaggaagatgggactggctgtttcgagatctttcacaaatgcgatgacgactgcatggcttcgattcggaataatacatacgatcactctaagtacagagaagaggctatgcagaacagaatccaaatcgatcccgttaagctgtcatcaggctacaaggacgtgatcctgtggttctctttcggggcgagttgctttatccttcttgccatcgtgatgggccttgtgtttatttgtgttaaaaacggtaacatgcgctgtacaatctgtata

SEQ ID NO: 690 - DNA, 1680 bp, Influenza A virus
  misc_feature (1)..(1680): Codon Optimized Sequence Encoding H7 Hemagglutinin
atgaacacacaaattctggtcttcgcactgattgcaatcatcccaactaacgctgacaaaatttgtctggggcaccatgcggtcagtaatggcaccaaggtcaacactctcactgaacgcggagtggaagtggtgaacgcaaccgagacagtggagcggaccaacatccccagaatatgctcaaagggtaaaaagactgtggatttgggacagtgcggtcttcttgggacaatcaccggccctccccagtgtgaccagttcctggaattctctgccgacctgattatagagcggcgtgagggctccgatgtgtgttaccccggcaagttcgtgaacgaggaggcactgcgacagatcttgagagaaagcggggggattgacaaagaggctatgggcttcacttattcgggcatcaggactaatggcgcaacctccgcttgtaggagatcaggatcctctttctacgccgaaatgaagtggctgctgtcgaatacagacaatgccgctttcccccaaatgactaagagttataaaaacacgcgtaaatccccagcgctgattgtctggggaatccaccactcggtgagcactgcagagcagactaaactgtacgggagcggcaataaacttgttacagtgggatcctcgaattaccaacagagcttcgtcccatcaccaggtgctcgaccacaggtgaacggccagtctgggcgaatagattttcattggctcatgcttaatcccaatgacactgtgactttttctttcaatggggccttcatcgcgcctgatcgggccagtttcctgagaggcaagagtatgggaatccagtccggcgtgcaggtggacgctaattgtgagggggattgctatcactcaggtggcactataatttcaaatcttcctttccagaacatcgattctcgagccgtcggaaagtgccctaggtacgtgaaacaaaggtcactccttttggcaaccgggatgaagaacgtgccagagattcccaagggtcgggggctctttggcgctattgctggatttatcgagaatgggtgggagggtctgatagacggttggtatggcttcagacaccagaacgcccagggggagggcaccgccgccgactataagagtacccagagcgcaattgaccagattaccggaaaattgaaccgactgattgagaagacaaatcagcagtttgagttgatcgacaacgaattcaatgaggttgaaaaacagatcgggaacgttataaactggacacgagatagcataacagaggtctggagttacaatgctgaactgctggttgctatggaaaaccagcatactattgaccttgcggacagcgagatggacaaactatacgaaagagtgaagcgccagctgcgtgagaacgccgaagaagacgggactggatgcttcgagatattccacaagtgtgatgacgattgtatggcaagcatacggaacaacacatacgatcatagcaaatatagggaggaggcgatgcagaacagaatacagatagaccctgtgaagttatcttccggttacaaagacgttatcctctggtttagcttcggagccagctgctttatattattagccatcgtcatgggcctcgttttcatctgcgtgaagaatggaaatatgcgctgcaccatctgcatc

SEQ ID NO: 691 - DNA, 1680 bp, Influenza A virus
  misc_feature (1)..(1680): Codon Optimized Sequence Encoding H7 Hemagglutinin
atgaatacgcagatcttggtattcgcacttatagccatcatccccaccaacgccgataagatttgcttaggccaccatgctgtttctaacggcacaaaagtgaacacacttaccgagagaggggtcgaagttgtgaacgccacggagacagtcgaaaggacaaacattcctcgaatctgcagtaagggcaagaaaacagtggatctcggccagtgtgggctgctgggaaccatcacgggtcctccgcagtgtgaccagttcctggagttctctgccgatctcatcatcgaaaggcgggagggatccgacgtgtgctacccaggcaaattcgtgaacgaagaagcgcttcggcaaattctgcgagagtcaggggggatagataaagaggcaatggggtttacttattctggcattagaaccaatggggccacgagtgcatgtagacggtccggaagtagcttttacgcagaaatgaagtggctgttgtctaacactgacaacgctgcatttccacagatgaccaagtcttataaaaacacgagaaaatccccagccctcattgtgtgggggatccaccattctgtgagcaccgccgagcaaacgaagctgtatggcagtggtaacaagctagtcacagtaggatccagtaattaccagcaaagcttcgtgcccagtcccggagctcggcctcaggtcaacgggcaatctgggagaatcgacttccactggctgatgctgaacccaaacgacacagtgacattttcttttaatggcgctttcattgcccccgacagggctagttttctgagaggcaagtccatggggatccaaagcggagtgcaggtggacgctaattgcgagggcgattgttaccacagtggggggaccattatcagtaatctgcctttccagaacatcgatagtagagccgtgggcaaatgtccacgttacgtcaagcagcggagcctgctcttagccacgggcatgaagaacgtgcctgagatcccaaagggcagagggctgtttggcgctatcgcgggattcattgaaaatgggtgggagggactaatcgacggatggtacggttttcgacaccagaacgcacagggggaagggacagctgccgattataagtctactcaatctgctatcgaccagataactgggaaacttaatcggctgattgagaaaacaaaccagcagtttgagctgatagacaacgaattcaacgaagtggagaaacagatcggtaacgtgataaactggactagggactctatcaccgaggtgtggtcctacaacgcggaactccttgtcgctatggagaatcagcacactatagacctggcagactctgaaatggataaactgtacgaacgggttaagcggcaattgcgggagaacgctgaggaggatggcacaggatgttttgaaatttttcataaatgtgacgacgattgcatggcttccattcgcaacaatacttatgatcattcgaagtaccgggaagaggccatgcaaaaccgtatccagatcgatcccgtcaaactgtcgtcggggtacaaggacgttatactttggttcagctttggagcctcttgtttcatcttgctcgctatagtgatgggcttggtgtttatatgcgtaaaaaatggcaacatgcggtgcacaatttgcatt

SEQ ID NO: 692 - DNA, 1680 bp, Influenza A virus
  misc_feature (1)..(1680): Codon Optimized Sequence Encoding H7 Hemagglutinin
atgaacactcagatactcgtctttgctctcattgcaattattcctaccaatgctgataagatttgcttggggcaccacgcagtttccaatgggacaaaggtgaacaccctaactgagcggggcgttgaagtggtgaacgcaaccgagacagtggaaagaacaaatatcccccgcatttgcagtaaaggcaaaaaaaccgtcgacttgggacagtgtggcctgcttgggactatcaccggacccccacagtgtgaccaatttttggagttttcagctgatctgattatcgaaagacgcgagggaagcgatgtttgctatccaggaaaatttgtgaatgaagaagcactccgacagatcctgcgggagtccggcggaatagataaggaagcaatggggttcacttactcgggcatccggactaacggagccacttccgcctgcagaaggtcaggctcgtcgttctatgccgagatgaagtggctgctttcaaacactgataatgccgcattcccacagatgacaaagtcatacaaaaacaccaggaaatcacccgcattgatagtgtggggcatccatcattctgtgtccactgccgagcagactaaactgtacgggagcgggaataagcttgttaccgtcgggtcaagcaactatcagcaaagttttgtaccaagcccgggcgcacggccccaggttaatggtcagtccggtcgcattgatttccattggctaatgctaaatccaaatgacactgtaacgttctcattcaacggagcgttcatcgctccagaccgtgcctcttttctgcgcgggaaaagcatggggatacagtccggggtgcaggtagatgctaactgtgagggagactgttatcactctggcggcacgatcatctccaaccttccctttcagaacattgacagcagagccgtcgggaaatgcccccgatatgttaagcagaggtcacttcttctcgctacgggtatgaagaatgtcccagaaattcctaaaggccggggattgtttggagcaatcgccggcttcatcgaaaacggttgggaaggcttgattgatggctggtacggcttccgccaccaaaatgctcagggagaaggaactgcagctgactataaatcaacacagagcgccattgaccagatcacagggaagctgaacagacttatcgagaaaaccaatcagcagtttgagctcatagacaacgaatttaacgaagtggagaaacagattggcaacgttatcaattggacccgggactcaatcactgaagtctggtcctacaatgcagagctgctcgtcgctatggaaaaccagcacactatcgatttggctgacagcgaaatggataaactatatgaaagggtcaagcgtcagctccgagaaaatgcagaagaggatggaacaggctgtttcgaaatcttccataagtgtgatgacgattgcatggccagtatcagaaacaacacttacgatcactccaaatacagggaggaggccatgcagaaccggatccagattgaccctgtaaaactgtcgagcggctataaagatgttatcctgtggttcagcttcggggccagctgcttcatactgcttgccattgtgatgggactggtgttcatttgcgttaaaaatggaaacatgagatgcaccatctgtatc

SEQ ID NO: 693 - DNA, 1680 bp, Influenza A virus
  misc_feature (1)..(1680): Codon Optimized Sequence Encoding H7 Hemagglutinin
atgaacacacaaatcctggtgttcgctctaatagcgatcatcccaaccaatgccgataagatctgtctgggccaccacgccgtatccaatgggactaaggttaatacactgacagagcgaggagtcgaagtggtgaacgcaaccgagacagtcgaaaggacgaatattcccaggatctgcagcaaggggaagaagactgttgacctgggacaatgtggcctactgggaactataaccggccctccacaatgcgaccaattcctggagttttccgctgacctgattattgaacggcgcgaagggagcgacgtatgttatcccgggaaattcgtgaatgaggaggctctgcgccagatcctgcgcgagagcgggggaatcgataaggaggccatgggtttcacctattccggaataaggactaacggcgcaacctcagcttgtagacgcagtggctcttctttttatgctgaaatgaaatggttattatcaaacacggacaacgccgcttttccccagatgaccaagagttataagaacacccggaaatcacctgctctgatagtatggggaattcatcactcggtgtccactgcggagcaaaccaaactgtacgggagcggcaataagttggttacagtaggaagctccaattatcagcaaagtttcgtcccctcccctggcgccaggcctcaagtgaacggacagtcagggagaatcgacttccactggctgatgctcaatccaaacgacaccgtaactttctcattcaatggggcatttatcgccccagaccgggcctcgttcttacgaggtaaatccatggggattcagagcggcgtccaagtggatgccaactgcgaaggcgattgctaccactctggtgggacaatcatctcgaacttgccgttccaaaacatcgattcccgagcagtggggaaatgccccagatacgtaaaacaaaggtcgctgctccttgctaccggcatgaaaaacgtccctgaaatcccaaagggtcgtggtctgtttggcgcaattgctgggtttattgagaacggctgggaaggcctgatagacgggtggtatggatttcgtcatcagaatgcacagggcgaggggaccgcagccgattacaagagtacccagtccgctattgaccagataacagggaaactgaaccggctgattgagaagaccaaccagcagttcgagttgattgacaatgagttcaacgaagtcgagaagcagatcgggaatgtaataaattggacaagagacagcattacagaggtgtggagctacaatgcagagctgttagtggccatggagaaccaacacacgattgaccttgccgattccgagatggacaagttgtacgagagagtaaagaggcagctgagggagaatgctgaagaagacggaacaggctgctttgaaatcttccacaagtgtgatgatgactgtatggcttcgatacgcaataatacatacgaccatagcaagtatcgggaggaagccatgcagaatagaattcagattgatcccgtgaaactaagctcgggatacaaggacgtgatactatggttttcatttggcgcctcctgtttcatcctcctggctattgtcatgggtttggtttttatttgtgttaaaaacggcaacatgcggtgtactatttgcatc

SEQ ID NO: 694 - DNA, 1680 bp, Influenza A virus
  misc_feature (1)..(1680): Codon Optimized Sequence Encoding H7 Hemagglutinin
atgaacacgcagatactggttttcgcactcattgcaatcatccctacgaacgccgacaagatttgtctgggccaccacgctgtctctaacggcaccaaggtgaacaccctgaccgagcgcggagtggaagtggtcaatgcgacagaaactgtggaacggacaaacattccacggatctgtagcaaaggcaagaagacagtggatctggggcagtgcggcctactgggcaccatcaccggacctcctcaatgcgatcagtttcttgagttttccgccgatttgattatagaaagacgggagggatccgatgtctgctacccaggcaagtttgtcaacgaggaggccctaagacagattctgcgggaatctggcgggatcgacaaggaggcaatgggcttcacctacagcgggatcaggacaaacggagccacaagcgcttgtaggcgctctggttcctcgttttacgcagaaatgaagtggttactttcaaatacggacaatgcggccttcccccagatgaccaaatcatataagaatactcgcaagagcccggcattgattgtctggggcatccatcattctgtgtctactgctgaacagactaaactgtatggctctggcaacaagctggtgactgtcggaagcagtaactaccaacagagcttcgtgcctagcccaggggcaagaccccaggtcaacgggcagagcgggcgtattgactttcactggctgatgctgaacccaaacgacactgtgacattcagtttcaatggggcctttatagcccctgacagggccagcttcttgaggggcaagtccatgggaatacagtctggtgtccaggtcgatgccaattgcgagggggactgttatcatagcggcggcacaatcatctcaaatctgcctttccagaatatcgatagtcgtgccgtgggaaaatgcccccgttatgtaaagcaaagatccttgctgctagctaccgggatgaagaatgtgccagaaattccaaagggacgaggcctgttcggcgctattgctggcttcattgagaacgggtgggaaggcctgatagatgggtggtacgggttcaggcaccagaacgcacagggcgagggtacagctgccgactataaatctacgcagagcgcaattgaccagatcaccgggaagctaaaccgtctgattgaaaagaccaatcaacaatttgagctcatagataatgagttcaacgaagttgaaaagcagattgggaacgtcatcaactggacacgggatagtataacggaagtgtggagttataacgccgaattactggtggcgatggaaaaccagcacactatcgatttggccgactccgagatggataagctgtacgagcgggttaaacgccagttaagggagaatgctgaggaggatggcacaggttgctttgagattttccataaatgcgatgacgattgcatggcctctattcgaaataacacatacgaccactcgaagtaccgtgaggaggcaatgcaaaatcgaatccagattgacccagtgaaactctccagtggctataaggatgtgatcttgtggttctcttttggggcctcatgttttattctccttgcgatcgtgatgggattggtttttatctgtgtcaagaatggaaacatgagatgcacgatctgtatc

SEQ ID NO: 695 - DNA, 1680 bp, Influenza A virus
  misc_feature (1)..(1680): Codon Optimized Sequence Encoding H7 Hemagglutinin
atgaatacacagatcttagtttttgcactaatagctatcatccccacaaacgccgacaaaatttgtctgggtcatcatgctgtgtctaacggtaccaaggttaataccctgaccgaacgcggggttgaggtggttaacgcgactgaaacggtggaacgcacgaatatacccaggatctgttcaaaaggcaaaaagaccgttgatctgggtcagtgcggccttctggggacaatcaccggccccccccagtgcgaccagttcctcgagtttagtgctgatttgatcattgagcgaagagaggggtccgacgtgtgctatccagggaagtttgttaatgaagaggcgttgcgccagatcctacgcgaatccgggggaatcgataaggaagcaatgggcttcacctattctggcattagaaccaacggagctacatccgcctgtagaaggagtggctcgtctttctatgcagagatgaaatggctgctgtccaacaccgacaatgccgctttcccccagatgactaaaagctacaagaatacccgaaaaagtccagctctgatcgtctggggcatccaccactcagttagtacagccgaacagacaaagttgtatggcagtggcaacaaactagtcacagttggctcgtccaactatcagcagagttttgtgcccagtcccggggcacgtccgcaggtcaatggacagagcggccggattgatttccattggctgatgctgaaccctaacgatacagtgacattttccttcaacggcgcgttcatcgcacccgatcgcgcttcattcctgagggggaagagcatggggattcagtcgggagtccaggttgacgccaactgtgaaggagactgctaccattcaggggggacaatcatctccaacctaccattccagaacattgattcaagagctgttggaaagtgtccaagatatgtcaagcaaaggtctctattgctagctaccggtatgaagaatgtccctgaaataccgaaggggaggggtctgttcggtgccatagctggttttatcgaaaatgggtgggagggtcttatcgacgggtggtatggatttcgccaccagaacgcccagggggaaggcactgcagctgactataagtcgactcagtctgccatcgaccagatcaccggtaaattaaatagactgattgagaagacaaatcagcaattcgagctcatcgataatgagttcaacgaggtcgagaagcagattggaaatgtgattaactggacgcgcgattccattaccgaggtgtggagctataacgcggagttgttagtggcgatggagaatcagcatacaattgatctagcggacagtgaaatggacaagctgtacgagagagttaaacgacagctgcgcgagaacgccgaggaggatgggacagggtgttttgagatcttccataagtgtgacgatgattgtatggctagcattagaaataacacttacgatcatagcaaatacagggaggaggccatgcagaaccgaattcaaatcgaccccgtgaagctgtcttcgggctacaaagacgttattctctggtttagctttggtgcgtcatgcttcattctgctggcgattgtaatggggttggttttcatatgcgttaagaacggcaacatgcggtgcactatttgtatt

SEQ ID NO: 696 - RNA, 1953 nt, Influenza A virus
  misc_feature (1)..(1): 7MeGpppG2'OMe- at 5' end
  misc_feature (1)..(1953): Codon Optimized Sequence Encoding H10 Hemagglutinin
  misc_feature (1953)..(1953): -OH at 3' end
ggaaauaagagagaaaagaagaguaagaagaaauauaagagccaccauguacaaaaucgucgucauuaucgcauugcugggcgcugucaagggacucgacaagaucugucucggacaccacgcgguggcuaacggaaccaucgucaagacccugacuaacgagcaggaagaagugaccaacgccaccgaaacuguggaauccaccgggaucaacagauugugcaugaagggucggaagcacaaggaucugggaaacugccacccgauuggaaugcucaucggcaccccggcaugcgaucugcaucugacugggaugugggauacccuuaucgagcgggaaaacgcgaucgcauacuguuaccccggugccaccgugaacguggaggcgcucagacagaagauuauggagucaggcggcaucaacaagauuuccacgggcuucaccuacggguccuccauuaacuccgccgguaccacucgggccugcaugcggaacggagggaacuccuuuuacgccgagcucaaguggcuugugucaaaauccaagggacagaauuucccccaaaccaccaacaccuauaggaacaccgacaccgccgaacaucucauuauguggggcauccaucacccuucgagcacacaggagaagaaugaccucuacggcacccagucgcugagcaucuccgugggcucaucgaccuaucgcaacaacuucgugccuguggucggcgcccgaccucaagucaacggacaguccggacgcauugacuuccauuggacucuggugcaaccgggagacaacaucacuuucucccacaacggcggacugauugccccaagccgcgugucaaagcugaucgguagagggcuggguauucagucggaugcucccaucgauaacaacugcgaauccaagugcuuuuggagaggcggcuccaucaauacucggcugccguuucagaaccugagcccgaggaccguggggcagugcccaaaauacgugaaucgccggucacugaugcuggcgaccggaaugaggaacgugccugaacucauccagggacgggggcuguucggcgccaucgccggcuuccuggaaaacggaugggagggaaugguggacgguugguacggcuuccgccaccaaaacgcccagggaacuggacaggccgccgacuacaaguccacacaggccgcaauagaccagaucacugggaagcucaaccgccuuguggaaaagacuaacacugaauucgagucgaucgagucugaguucuccgagaucgaacaccagauugggaacgugaucaacuggacgaaggacuccauuaccgacaucuggaccuaccaggcggaacugcucguggcgauggagaaccagcacacuaucgacauggccgacuccgagaugcugaaucuguacgaacgcgugcggaagcaacugagacaaaacgcugaagaagauggaaaggguuguuucgagaucuaccacgccugcgacgacagcugcauggaaagcauuaggaacaauaccuacgaccacucgcaguaccgggaggaggcccuucugaaccggcugaacauuaaccccgugaccuugagcuccggcuacaaggacaucauccugugguucucguuuggagccagcugcuucgugcugcuggccgucgugaugggauuguucuucuucugccugaaaaacggaaacaugcgcugcaccaucuguauuugauaauaggcuggagccucgguggccaugcuucuugccccuugggccuccccccagccccuccuccccuuccugcacccguacccccguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 697 - DNA, 1683 bp, Influenza A virus
  misc_feature (1)..(1683): Codon Optimized Sequence Encoding H10 Hemagglutinin
atgtacaagatcgtcgtgattatcgcccttctgggggcagtcaagggactagacaaaatatgcctgggccatcatgcagtggctaacgggacgatagtgaagacgctgaccaacgaacaggaggaggtcactaacgccactgagacagtggagtcgacgggcatcaatcgtttgtgcatgaaaggccggaaacacaaagacttaggtaattgtcatccgatagggatgctgataggcacccctgcatgcgacctccatctcactgggatgtgggacaccctgatcgaaagggaaaatgcaatagcctattgctaccccggtgctaccgttaatgtcgaggcgctgagacagaaaatcatggaatccgggggaatcaacaagattagcacggggtttacatatgggagctcaataaattccgccggtactacccgagcatgcatgcggaacggcggaaatagtttttatgccgaactcaagtggcttgtctccaagtctaagggacaaaatttcccgcagacaacaaatacgtatcgtaacactgataccgccgagcatcttatcatgtggggcatccatcaccctagctcaacgcaggagaaaaacgacttgtacggtactcagtctctatctatctccgtgggatcttccacctatagaaacaattttgtgcccgtcgtaggggcccgccctcaggtgaatggccagtcaggccgtatagacttccattggactctcgtacagcccggggataatataacctttagtcataacggaggcctcattgctcccagcagggtttctaagttgatcggtcgcgggctgggcattcagtctgatgccccaattgataacaactgtgaaagcaagtgcttctggaggggtgggagtatcaatactagactcccattccagaacttgtctccgcggactgtaggacagtgcccaaagtatgtgaatcgtcggtctctcatgctggcaaccggtatgagaaatgttcctgagctaatacagggaagaggactttttggagcaatcgccggatttttagaaaatggttgggaggggatggttgacggatggtacggtttcaggcaccagaacgcccagggaaccggccaggccgcggactacaaaagcacacaggcagccattgatcagattactggcaagctgaaccgcttagtcgagaagaccaacacggaatttgaatcaatcgagtcagaatttagcgaaatcgaacatcagattgggaacgtaattaattggacaaaagatagcatcacagatatttggacctaccaggctgagctactggtggctatggagaaccaacacactattgatatggccgacagcgaaatgttaaatttgtatgaacgggtacggaagcagcttagacagaacgcagaagaagatggcaagggctgctttgaaatttaccacgcttgcgatgacagttgcatggagtctattaggaacaatacatatgatcactctcagtacagagaggaggccttgctcaataggctgaatatcaaccctgtcaccctgagcagtggttataaggacatcatcctgtggttcagctttggcgcttcatgtttcgtgctgctggctgtcgtcatgggccttttctttttttgtttgaagaacggcaacatgcgttgcactatctgcatc

SEQ ID NO: 698 - DNA, 1683 bp, Influenza A virus
  misc_feature (1)..(1683): Codon Optimized Sequence Encoding H10 Hemagglutinin
atgtacaagatcgtggtgatcatcgctctgctcggcgccgttaagggactggataagatttgtttagggcaccatgcagtggcaaacgggaccattgtcaagacactcaccaatgaacaggaggaagtgaccaacgcgactgagactgttgagtccaccggcataaacaggctttgtatgaaaggcagaaagcacaaggatttgggtaattgtcacccaataggaatgctaattgggactcctgcctgcgatctccacctgacaggcatgtgggacaccctgattgaacgggagaatgctatcgcatactgctacccaggtgcaaccgtaaacgtggaggccctgcgacagaagataatggagagcggaggcatcaacaagatcagtacgggatttacctacgggtcttctatcaattcggctggcacaacacgtgcttgcatgagaaacggaggcaactccttctacgctgaactcaaatggttggtgagtaagagtaagggtcagaatttcccacagacgaccaacacatacaggaacaccgatacggccgaacacctcatcatgtggggcatacaccaccctagtagtacacaagagaaaaacgacctgtatgggacacaatccctttcaatcagtgttggtagctcgacctaccgtaataatttcgtccctgtggtgggtgctagaccgcaggtcaatggccagtcaggaaggatcgatttccactggaccctcgtgcagccaggtgataacattactttttctcataatggcggactaattgcgcctagcagggtgtcaaagcttattgggagaggcctaggcatacaaagcgacgccccaatcgataacaattgcgagtcgaagtgtttctggaggggcggatcaattaacacacgtctgcccttccagaatctgtcaccaaggactgtgggccagtgtccaaagtatgttaatcgacgttcactcatgcttgccaccggcatgcggaatgtgcctgaactgattcagggccgcggactttttggcgccattgcaggtttcttggagaacgggtgggaaggtatggtcgacggatggtatggcttcagacaccagaacgcccaaggaactggccaggccgccgattataagagcacccaggctgcgatcgatcaaattaccggtaaactcaaccggctggtcgagaagactaatacagagtttgagtcaatagaatccgagttttccgaaatagaacatcagatcggtaatgtaatcaactggaccaaggacagcatcaccgacatatggacataccaggccgaactgctcgtcgccatggagaatcaacacacgattgacatggccgattcggaaatgctgaatctgtacgaaagggtgcgtaaacagttgcggcagaatgcagaagaagatggaaaagggtgttttgaaatctaccacgcctgcgacgatagctgcatggaatctatccggaataacacctatgaccattcccaataccgagaagaggccctgctcaaccgcttgaacattaatcccgttacattgtcatccggatacaaggacatcatcttgtggttctctttcggggcttcctgttttgtgcttctagcagttgtgatgggtctgtttttcttctgcttaaagaacggcaatatgagatgtactatttgcatc

SEQ ID NO: 699 - DNA, 1683 bp, Influenza A virus
  misc_feature (1)..(1683): Codon Optimized Sequence Encoding H10 Hemagglutinin
atgtacaaggtagtggtaattatcgctctgctaggtgccgttcgtggcttggacaagatttgtttggggcaccatgccgtagccaacggaacaattgtgaagacactgactaacgaacaagaggaagtaaccaacgctacagaaacagtcgaatctaaaagtttgggcaagttatgtatgaaagggcggagttacaacgacctcggaaattgccaccccatcggaattttaatcggcactccagcctgcgatctgcacttaacaggaacctgggacaccctcatcgaacgcgaaaatgccgttgcatactgttacccaggtgcgactgtcaacgaggaagcgctccgccagaagatcatggaaagcggggggatttcaaaaatctctaccgggtttacatacgggacttccatcaacagcgctggcaccacaaaggcctgcatgcgcaatggcggtaacagcttctacgctgagctcaagtggctggtcagcaaaaacaaaggccagaacttcccccaaactactaatacctacagaaacacagataccgccgagcacctcataatttgggggatccatcacccatctagcactcaggagaaaaacgatctctatggcacacagtctctcagcatttcagtgggaagctcgacataccagaataactttgttcccgtggtgggcgcaagaccacaggtcaacggccagtccgggagaattgatttccattggacgctgctgcaacctggagacaacatcaccttttctcataatggcggcctaattgcgccttccagagttagcaagctgatcggccggggcctaggtattcagagcgaggccccaattgacaacggttgcgaatcaaagtgcttctggaaaggcggatccattaacacgaagttgcccttccagaacttatcacccagaaccgtggggcagtgtcccaaatacgtgaataagaggtccctgatgctcgctaccggtatgcggaatgtgcctgagataatgcatggaagaggactgtttggggcaatcgctgggtttatcgaaaacggttgggaagggatggttgatggatggtacgggtttcggcatcagaatgcacagggaactggtcaggccgccgattacaaatcaacgcaagccgccatcgaccagataactggaaagctgaataggctcatcgaaaaaaccaacaccgagttcgaatcaattgagtctgagttctctgagatcgagcaccaaatcgggaatatcatcaattggaccaaagatagcattactgatatctggacatatcaggctgagctgctggtcgccatggagaaccagcatacaatcgacatggcagactcggagatgcttaacctgtatgagagggtgcgtaaacaattgcgacagaatgccgaagaggatggtaagggttgcttcgaaatctaccacgcttgcgacgattcttgcatggaaagtataagaaataatacctatgatcattcacaataccgcgaagaggctttgctgaacagactcaacatcaatccggtgaagctttcctctgggtacaaggatataattctgtggttttcctttggagcttcctgtctcatattattggctgttgttatgggcctcgtttttttttgcctgaagaacggtaacatgcgctgtacaatatgtatc

SEQ ID NO: 700 - DNA, 1683 bp, Influenza A virus
  misc_feature (1)..(1683): Codon Optimized Sequence Encoding H10 Hemagglutinin
atgtacaaaattatcgtgatcatcgctcttctgggcgccgtcaaaggtctcgataaaatttgccttgggcaccatgctgtggcaaacggaactattgtaaaaactcttacgaatgagcaagaagaggtgaccaatgccaccgaaaccgtcgagtccaccgggatcaataggttgtgcatgaaggggcgtaaacacaaggaccttggcaattgccatccgatcggcatgttgatcggaacaccagcttgtgaccttcacttgaccggaacatgggacactctgatcgagcgagagaacgcaattgcatattgctatccgggagcaaccgtgaatgtggaggccctgcggcagaagatcatggaatccggaggtatcgacaaaatctctaccggattcacctacggatcttcaattaactccgctggcactacacgcgcttgcatgcgaaatggcggtaactcattctacgccgagctgaagtggctggtgtccaagtctaaagggcagaattttccgcagaccactaacacctacagaaacactgataccgccgaacatctcattatgtggggaatccaccacccatcaagcactcaagaaaaaaacgacttgtatggtacacagtcactaagcatttccgtgggcagctctacctaccgcaacaactttgtccccgtggttggcgcccgaccccaagtaaatggtcagtccggcaggatcgattttcattggaccctggtgcagccaggggataacatcacttttagccataacggcggcttgatagcgccgtcaagggtgtccaaactgatcggaagagggctgggaattcagagtgacgcacccatcgataacaactgcgaaagcaaatgtttctggcgggggggttcgatcaacacccgattacctttccagaacctctcccccaggactgttggtcagtgcccgaaatatgttaatcgacgcagcttgatgctcgccaccgggatgcgcaatgttcccgagctcattcaggggcgtggcctctttggcgcaatagctgggttcctcgagaatggttgggaaggcatggtggatggatggtacggcttccggcatcaaaacgcacagggcacaggccaggccgcagattacaagtctacacaggccgccattgatcagattacaggtaaactgaacaggctagtggaaaagaccaataccgagttcgaatccatcgaatctgagttctcagagatagagcaccagatcgggaacgttatcaactggaccaaggacagcattaccgacatttggacctaccaggcagagctcctggtcgccatggaaaatcagcataccatcgacatggccgattcagagatgcttaacctttatgagcgggtgaggaaacagctgaggcagaatgcagaagaagatggtaagggttgcttcgaaatttaccatgcttgtgatgatagttgtatggagagtatccgtaacaatacttacgatcacagccagtacagggaagaagcactcctcaatcgcctcaacatcaatcctgtaactctctcgtctggttacaaagatatcatcttatggttctcttttggggcctcatgtttcgtgctcctggccgtggtgatgggcctgttctttttctgcttaaagaatggaaatatgaggtgcacaatctgcatt

SEQ ID NO: 701 - DNA, 1683 bp, Influenza A virus
  misc_feature (1)..(1683): Codon Optimized Sequence Encoding H10 Hemagglutinin
atgtacaagatagtcgttatcatcgccttactcggagcagttaaaggtttagataagatctgcctggggcaccacgccgtcgctaacggcactattgtgaagacgctgaccaatgaacaagaggaagtcactaacgcaacagaaaccgtggagagcactggcatcaatcgcctctgtatgaaagggcgcaagcataaggacctcggcaattgccaccctataggcatgctgattggaacgcctgcttgtgaccttcacctgacagggatgtgggataccctaattgaacgagagaacgcgatcgcatactgctatcctggtgccactgtgaacgtggaagccttacgccaaaaaatcatggagagcggagggatcaataaaatcagtacaggtttcacctacggatcctccatcaacagtgccggtactacacgcgcctgtatgagaaacggaggcaacagcttctatgctgagctgaaatggttagtgagcaaatccaaaggtcagaattttccccagaccacaaatacttaccgaaatacggacaccgccgagcatctgataatgtggggcatccaccatcctagttctactcaggagaaaaacgacctttatggaacgcagagcctgtctataagcgtggggtcttcaacatacaggaataactttgtccctgtagtgggcgccggtcctcaggtgaatgggcaaagcggccgcatcgattttcactggaccctggttcaacctggagacaatattacgttcagtcacaacggcggccttattgccccttccagagtctctaagctcattggcaggggactcggtatccaatccgacgcccctattgacaacaactgcgagtccaaatgcttctggaggggaggaagcatcaacacccgcctgccatttcagaatctttcacctcgaaccgtgggccagtgtcctaaatacgtcaatcggagaagcttgatgttggccactgggatgcggaacgtacccgagcttatccaaggcagaggccttttcggtgccatcgcagggttcttggaaaatggctgggaaggcatggtcgatggctggtatggctttcgccatcaaaatgctcagggcacgggccaggccgctgactacaaaagtacacaagctgccatcgatcagattacaggcaagctcaataggttggtggagaagacaaacaccgagtttgagtcaatcgagagcgagtttagcgagatagagcatcagatcggcaacgtgattaactggactaaggactctataacagacatttggacgtaccaggcagagctccttgtagcaatggaaaatcagcacacaattgacatggctgactctgaaatgctcaacctgtatgagcgggttcggaagcagctgaggcagaatgcagaggaagatggtaagggctgctttgaaatctaccatgcctgtgatgacagttgcatggagagtattcgaaataacacatacgatcattcgcagtacagagaggaagccttgttgaaccgcctgaatatcaaccccgtgacattatcctcaggctataaagacatcatcctctggttttcgtttggggcctcgtgctttgtcttgctggctgttgtcatggggctgtttttcttttgtttaaagaacgggaacatgcgatgcacaatctgtatt

SEQ ID NO: 702 - DNA, 1683 bp, Influenza A virus
  misc_feature (1)..(1683): Codon Optimized Sequence Encoding H10 Hemagglutinin
atgtacaagattgtgctggtacttgcacttctgggtgccgttcacggcctcgacaaaatctgcctaggccaccacgctgtgcctaacgggaccattgtgaaaaccctgactaacgagaaggaggaggttaccaacgcaaccgagactgtagagtctaagtccttggataaactgtgcatgaagaaccgaaactacaaagacctgggcaattgccatcctatcgggatggtcgtcggaactccagcctgcgatctccacctaactggcacctgggacaccctcatcgagagggacaattcaattgcatactgctatcctggggctaccgtgagtgaagaagcactgcgacaaaaaatcatggagtcaggagggatcgacaaaatatcgacgggattcacatacggctcatctattaattcagcaggaaccacgaaagcttgtatgcgcaacggaggtaactccttctatagcgaactcaagtggttagtgtctaagaataagggacagaactttccacagacaacaaacacttaccggaacacagacagcgtagaacacctcataatatgggggatccaccacccaagctccacacaggagaagaacgatttatacggcactcagtccctgagcatcagcgtcggatcaagcacctaccagaacaacttcgtccccgtggtgggagctcgcccacaggtgaatggccagagcggacgcatcgatttccactggactatggtccagccgggtgacaacatcaccttctctcacaatggggggctgattgctccgaaccgagtgtccaagctgaaagggagggggttaggaatccagagcggcgcctcggtagacaacgactgcgagagcaaatgtttctggaaaggtggctcgattaataccaagcttccatttcagaatttatctcctagaactgtcggccagtgtccaaaatacgtcaacaaaaagtctctgctcctcgcaacaggcatgcggaatgttcccgaagttgcacagggccgaggcctgtttggtgccattgccgggtttatcgagaacggatgggagggcatggtggatggatggtacggattccgacaccagaatgcgcaggggacgggccaagcagcggattacaagtccacacaagcagcaattgaccaaatcactggcaagttgaatcgcctcatagagaaaactaatacagagttcgaatctatcgaaagtgagttttccgagatcgaacaccagatcgggaatgtgatcaactggacgaaggattctattactgacatatggacctaccaggccgagctcctggtggctatggaaaaccaacatacaattgacatggctgactctgaaatgctgaatctgtacgaacgagtgaggaagcagctccgccaaaacgcagaggaagacggaaagggttgttttgagatatatcacaagtgcgacgacaactgcatggagtccatccgaaacaatacttacgaccatacacaatacagagaggaggccctgctgaaccgcctgaatatcaatcccgtgaagctcagttccggttacaaggacgtcattttatggttcagctttggagcgtcctgcttcgtgcttctggccgtcatcatgggccttgtcttcttttgtctgaaaaacggtaatatgagatgcaccatctgcatt

SEQ ID NO: 703 - DNA, 1683 bp, Influenza A virus
  misc_feature (1)..(1683): Codon Optimized Sequence Encoding H10 Hemagglutinin
atgtataaaattgtcgtgatcatcgccctgctcggggccgtcaagggattggataagatatgtctcggtcatcatgcagtggctaacggcacgatcgtgaagaccctgaccaacgagcaggaggaagtgactaatgccaccgaaaccgttgagtctactggtatcaataggctgtgcatgaaagggagaaagcacaaggacctcggcaattgtcacccaatcgggatgctcattgggacacccgcatgtgacctccacctgacaggcatgtgggatacactgattgagcgcgaaaatgccatcgcgtactgctaccctggcgccaccgtgaatgtggaagctctgcgacagaaaataatggagagtggggggattaataagatctctacagggtttacgtacggatcaagtattaactccgccgggactactcgagcatgtatgcgcaatggcggcaattccttttacgccgagctgaagtggcttgtgtcgaagtcaaaaggacagaattttccccagacaacaaacacatatcgcaataccgatactgcagaacacttgattatgtgggggattcaccacccgtcatctactcaggagaagaacgatctgtatggcactcagagcctgagtatctcagtaggcagcagcacctacagaaataacttcgtgccggttgtcggggcccgcccacaagtgaatggccagtcagggcggatcgactttcactggacgctggttcagcctggagataacattacgtttagtcacaatggcgggctcatcgcgccaagtcgggtatccaaactgatcggccgaggacttgggatacaatcggacgcccccatcgataacaattgcgaatccaaatgtttttggagaggaggatccataaatacacgactgccctttcagaacctgtctcctcggacagttgggcagtgtccaaagtacgtaaaccggaggtctctcatgctcgcgacaggaatgcgtaatgtgccagaactgattcagggccgcggcctcttcggtgcgatcgcggggttcctcgagaatggttgggaaggcatggtggacgggtggtatggttttcgtcatcagaacgctcaaggcactgggcaggccgccgattacaagtccacgcaggcggcaattgaccaaatcaccgggaagttaaaccggcttgtcgagaaaaccaataccgagtttgaatccatagagtccgagttttccgagatcgagcaccaaatcggaaacgttataaattggaccaaggactctatcaccgacatctggacctaccaggccgaactcctggtcgccatggaaaatcagcacacaatagacatggcagattcagagatgctgaacctgtacgagcgggtgcgtaagcagctccggcagaatgcggaagaggacggcaagggatgtttcgaaatataccacgcttgtgatgattcatgtatggagtcgatcaggaacaatacatacgaccattcccagtacagggaagaggccctcctgaacaggcttaacatcaaccccgtcaccctgtccagcggctacaaggatattatcctttggttttcattcggcgcaagctgcttcgtcttactggccgtggtaatgggactattctttttttgcctgaaaaacggcaacatgaggtgtaccatttgtatt

SEQ ID NO: 704 - DNA, 1683 bp, Influenza A virus
  misc_feature (1)..(1683): Codon Optimized Sequence Encoding H10 Hemagglutinin
atgtacaaaatcgtgctcgttctggccctgctcggcgccgtgcacggcctcgacaagatttgcctgggacatcacgctgtgcccaacggtactattgtcaagacactgacgaacgaaaaagaagaggttacaaacgctaccgaaaccgttgaatctaagagcttggataaactgtgcatgaaaaatcgcaactataaagacctcggtaattgtcaccctatagggatggtggtcggcaccccagcttgcgacctgcatttgacaggtacttgggatactttgatcgaacgggataacagtatcgcctactgttatccgggagccacggtgtcggaagaggctctgcgtcagaaaatcatggagagcggcgggatagacaagatctccactggcttcacttatggctccagcattaatagcgcaggtacaaccaaggcttgcatgagaaatggggggaactccttctactcagaactgaaatggctggtgtccaaaaataagggacagaatttcccgcagacgacaaacacctatagaaacacagactctgtagagcacctcattatttggggtatccatcacccaagctccacccaggaaaagaatgacctgtacggcacacagtccttgagcatttcagtgggcagctccacatatcagaataactttgtgccagtcgttggcgcacgaccccaggtgaatgggcagtcaggtcgcattgacttccactggactatggtgcagcccggcgataacattaccttctcccataacgggggactgatagcccccaatagggtctctaagctcaagggtcggggtttgggcatccagtccggagcatccgtcgataacgactgtgagtcgaaatgcttttggaaaggtggatccatcaatacaaagctacctttccaaaatttatcccctcgaacggtcggacagtgccctaaatacgtaaacaagaagtcactgctcctcgctaccggcatgcgcaatgtacctgaagttgcccaaggacgggggcttttcggcgcaatcgctggcttcattgagaatggatgggagggcatggttgacggctggtacggctttaggcaccagaatgctcagggtaccggtcaggcagcagattataaaagcacccaggctgccatcgatcagataaccgggaagttgaacaggctgatcgagaagaccaacactgagtttgagagcattgaatcggagttctcggaaatcgaacatcaaatcggcaatgtgatcaattggactaaggattctatcaccgacatctggacgtaccaggcagaactgttagttgcaatggaaaatcagcatactattgatatggcagacagtgagatgctgaacctgtacgagcgtgttagaaagcagctcagacagaacgccgaggaggacgggaaaggatgctttgaaatctatcacaaatgtgatgataattgcatggagtcaatcaggaataatacatacgatcacacgcaatacagagaggaggctctcctgaaccgccttaatatcaaccccgtgaaactcagctccggatataaagacgtcatcctctggttttcttttggagcaagctgcttcgtgctgctcgccgttatcatggggttggtgttcttctgcctgaagaatggtaacatgagatgcaccatttgtata

SEQ ID NO: 705 - DNA, 1683 bp, Influenza A virus
  misc_feature (1)..(1683): Codon Optimized Sequence Encoding H10 Hemagglutinin
atgtacaagattgtgctcgttctggcactattgggcgcagtgcatggtctggataaaatctgtctgggtcatcacgcagtgcccaacggtactatcgtcaaaacactaacgaacgagaaggaagaagtaactaatgcaacggagacagtggagtcaaaaagtctggacaagttatgtatgaagaacagaaactataaggatctcggtaattgccaccccatcggtatggtggttgggaccccagcctgcgaccttcacctgacgggaacctgggacaccctcatcgagcgggacaactccattgcctattgctatcctggggccaccgtctccgaggaggcactgaggcagaaaattatggaatccggcgggattgacaagatttctaccggctttacctatggctcctcaatcaacagcgctgggacaactaaagcctgcatgaggaacggaggaaattctttttactctgagttgaagtggttggtgagcaaaaataagggccaaaattttcctcagacgaccaatacctaccgtaatactgactcagttgagcacctcatcatttggggaattcatcatcccagcagcactcaggagaagaatgatctgtacgggacccaatcgttgagtatatccgtgggatctagtacttatcagaacaactttgtacctgtagtgggtgcccgcccacaggtaaacggacagtcggggcgtattgactttcattggacaatggtgcagcccggggataatatcacttttagccataatggaggcctgatcgcaccaaaccgagtgagcaagctgaagggtagaggattgggaatccagtctggagccagcgttgataacgactgtgagtctaaatgcttctggaaagggggtagcataaataccaagctgcccttccaaaacctgagccctcggaccgtgggccagtgcccaaagtacgtgaataagaaaagcctcctgctcgctacaggcatgagaaatgtgcccgaggttgcacagggcagagggctcttcggcgctatagctggattcattgaaaatggctgggaaggtatggtagatggttggtacggcttcagacaccagaatgctcagggaaccggacaggctgctgattataaatctacccaggctgctatcgatcagatcactgggaaattgaaccggctgatcgaaaaaacaaacaccgaattcgagagtattgaatccgagtttagcgaaattgaacatcagatcggcaatgtgataaactggactaaggatagtataactgacatctggacataccaagctgagctcctggtggccatggagaatcaacacacgatcgacatggcagactctgaaatgttgaacctgtacgagagggtgcggaagcagctcagacaaaacgctgaggaggacggcaaaggttgcttcgaaatctaccataagtgcgacgataactgtatggagagtattagaaacaatacctacgaccacacgcagtatagggaggaggctctgttgaataggttaaatatcaaccctgtgaaactatccagcggctataaggacgtgattttatggttctcgtttggtgccagctgttttgtcctactggcagtgatcatgggtcttgtttttttttgcctgaagaacggcaacatgagatgcacgatatgtatt

SEQ ID NO: 706 - DNA, 1683 bp, Influenza A virus
  misc_feature (1)..(1683): Codon Optimized Sequence Encoding H10 Hemagglutinin
atgtacaagatcgttgtgattatcgccctgctcggcgccgtcaaaggattagacaagatctgtctaggccatcacgccgttgcgaacggaaccatcgtgaagaccctgacaaatgagcaggaagaagttaccaatgccactgagaccgtagaaagcaccgggatcaacagactatgtatgaaaggccgcaagcataaggatctgggaaactgccatcctatcggaatgctcattggaactcccgcctgtgacctgcacctgaccggcatgtgggacacactgattgagcgggagaacgccatcgcttactgttatcctggtgcaactgtgaacgtcgaagctttgcggcagaaaataatggaatcgggggggattaataaaataagtaccggattcacatatggaagctcaattaactccgcaggaactacaagagcatgtatgcgaaacggcggcaactcattctacgctgaacttaagtggctggtgtctaagtcaaaggggcagaactttccgcaaaccactaatacatatcgcaatacagacacagccgagcacctcatcatgtggggaattcaccacccaagtagtacccaggagaagaacgacctgtacggcactcagtcgcttagcataagtgttggctcatcgacttatcggaataacttcgtcccagtggttggtgctcgtccccaagtgaatggtcagtccggcagaattgattttcattggacactggtgcaacccggtgacaacatcacttttagccataatggtggtctaatcgccccgtcccgggtgtccaagttaattgggagaggtctgggtatccagagtgatgctccaatcgataataattgcgagagtaagtgcttctggcgcggcggaagtatcaacacccggctccctttccagaatctatcacctagaactgttgggcagtgccctaaatatgttaatcgccgctcacttatgctggcaaccgggatgcgaaacgttccagaactgatccaagggcgggggcttttcggggctattgccgggtttttggagaacggctgggaagggatggtcgatggttggtatggcttccgccatcagaatgcacagggtaccggccaggccgccgactacaagtcaacgcaggctgcaattgaccaaatcactgggaaactgaaccggctcgttgaaaagactaacactgagtttgaaagcatagaaagtgaattcagtgaaattgagcatcaaatcggcaacgtgatcaattggaccaaggactcaatcacggatatctggacataccaggccgagctgctcgttgcgatggagaaccaacacaccatcgatatggcagactctgagatgctaaatctctacgaaagagtgagaaagcagttgcgacaaaatgcggaggaggatggtaagggttgcttcgaaatttaccatgcctgcgacgacagttgcatggaatccattaggaacaatacctacgatcattcgcagtatagggaggaggccctcttaaaccgcctgaacatcaacccagtaaccttgagcagcgggtataaagatataatcctgtggtttagcttcggtgcctcctgctttgttctgctggccgtagtcatgggtctgttttttttctgcctgaagaatggtaatatgcgctgcaccatttgcatt

SEQ ID NO: 707 - DNA, 1683 bp, Influenza A virus
  misc_feature (1)..(1683): Codon Optimized Sequence Encoding H10 Hemagglutinin
atgtacaagatcattgtaatcatcgccttgttgggagccgtcaaagggctcgataaaatttgcttgggccatcatgcagtcgccaacgggacaatagtcaagacgctcacgaatgaacaggaggaagtgacaaacgccacagaaaccgttgaaagtacagggattaataggctgtgtatgaaagggcgcaaacataaggatttgggcaattgtcacccaatagggatgcttattgggacaccagcttgtgatctccatctcactggaacatgggacaccctaatcgagcgcgaaaacgctattgcatattgctatccgggagcgacggttaacgtggaggcactccgacagaaaatcatggagagcggggggatcgacaagatttccacaggctttacttacggctctagtataaattccgccgggaccacaagggcctgtatgagaaacggtggcaacagtttttacgctgagttaaaatggctcgttagcaagagcaagggtcagaactttccgcagaccacaaacacataccggaacaccgatacagcagagcatctaatcatgtggggcatacatcatccttccagtacccaggagaagaacgatttatacgggacccaatccctgagcatcagcgttgggtcatctacttaccgcaataattttgtcccggttgtgggagcaaggccccaagtgaatggtcagagtggcaggattgactttcactggacactggtgcaacctggtgacaacattaccttcagccataacggaggactgatcgcgccttcacgggtgagcaagcttattggtagaggactcgggatccaaagtgatgccccaatcgacaataactgtgagagcaaatgcttttggcgagggggatccatcaatacacgcctcccctttcaaaacctgagcccacgcactgtggggcaatgccctaagtacgtaaaccgcaggtctctaatgcttgcaaccgggatgagaaacgttccagaattaattcagggacggggactgtttggggcgatcgccggctttctggaaaatggctgggaagggatggtggatggctggtatggcttccggcaccaaaatgcccagggcacagggcaggctgcagattacaaatcaactcaggctgccatcgaccaaatcacaggcaagctgaataggctcgtggagaaaacgaacacggaattcgagtctattgaatctgagttctccgaaatcgagcaccagatcgggaatgtaattaactggaccaaggactcaatcactgacatttggacctatcaggcagaattactggtagcgatggagaaccaacacacaattgacatggcagattctgaaatgctcaacctctatgaacgagtgaggaaacagctccggcagaacgccgaggaggatggaaagggatgtttcgagatctatcacgcatgtgacgatagctgtatggaatctatacggaataacacatacgatcattctcaatatcgggaggaggctctgcttaaccgactcaacataaacccagtcactctatccagtggctacaaggatattatcctgtggtttagctttggcgcctcgtgcttcgtgcttctcgctgttgtcatgggcctgttcttcttctgtctgaagaacgggaatatgcggtgcaccatttgcatc

SEQ ID NO: 708 - DNA, 1683 bp, Influenza A virus
  misc_feature (1)..(1683): Codon Optimized Sequence Encoding H10 Hemagglutinin
atgtataaaatcgtggttattatcgcattgctgggtgctgtgaaaggcctcgataaaatttgcctcgggcatcacgccgtggccaacggcacaattgtgaagacactgacaaacgaacaggaagaagttaccaacgctactgagaccgtggaatccacaggtattaataggctttgtatgaagggtcggaagcacaaagacctggggaattgccaccctatcggaatgctcattggaactccggcctgtgacctgcacctcacaggtatgtgggatactctgattgagcgagagaacgcgattgcctactgttacccgggagcaaccgtgaacgtggaggcgctccggcagaagatcatggagtctggcggcattaacaagatcagtaccgggttcacatatggaagttcaatcaatagtgccggcactaccagggcatgtatgcgcaacggaggaaatagcttctacgcggaattgaaatggttagtcagcaagagcaagggacagaactttcctcagactacgaacacttaccgtaatactgatactgccgaacatctaattatgtgggggatccatcacccatccagcacccaggaaaagaacgatttgtacggcacccagtctttatctatttccgtggggagttcgacatatagaaataactttgtgcccgttgtcggtgctgggccccaagttaacggccaatcgggacgtatcgatttccactggacactggttcagccaggggacaatatcaccttttctcacaacggaggtcttatagctccatctcgtgtgtctaaactcattggacgggggcttgggatccaaagcgatgcccccatcgacaataattgcgaaagtaagtgcttctggcggggaggttctattaatactaggcttcctttccagaacctctcaccacgaacagtcggccaatgccccaagtacgttaatcgacgttcactcatgctggccacgggaatgcgcaacgtgcccgagcttatccaggggcgcggattgttcggcgccatcgctggcttcttggagaacggttgggagggtatggtcgatgggtggtacggctttcgccaccaaaacgctcaagggacaggacaggccgccgattataagagcactcaggccgccatagatcagattacgggcaagctaaacaggctggtcgagaaaaccaatacggaattcgagtccattgaatcagagttctctgagatcgagcaccagatcggcaacgtaatcaactggaccaaagattctatcaccgatatttggacatatcaggcagaactactggtcgccatggaaaaccagcataccatcgatatggcggacagtgagatgcttaatctctacgaaagagtacgaaagcagctgcgacaaaacgccgaggaagacggtaaaggctgcttcgaaatttatcacgcgtgcgacgactcttgtatggaatctatacgaaacaacacatacgatcactcccaataccgggaggaggctctcctcaatagactgaatatcaacccagtcactttgagtagtgggtataaggacattattctttggttctccttcggggcttcttgttttgtccttctggcagtggttatggggctcttctttttttgcctcaagaacggcaacatgcgctgtactatatgtatt

SEQ ID NO: 709 - DNA, 1683 bp, Influenza A virus
  misc_feature (1)..(1683): Codon Optimized Sequence Encoding H10 Hemagglutinin
atgtataaagtcgttgtgatcatcgctttgttgggagctgtccggggtttggataagatctgcctcggccatcacgcagtagcaaatggaaccactgtgaagaccctaactaacgaacaagaggaagtcacaaatgccactgagactgtcgagtctactagcctgaataaactgtgcatgaaggggaggaggtacaaagatcttggaaattgccacccaatcggaatgctgataggcacccctgtgtgtgatctccatctgaccggaacatgggataccctgattgagagagagaatgctactgcatactgctaccctggagtcactatcaatgaagaggccctgcgtcaaaagatcatggagtccgggggtatttctaagatgcgcaccggctttacctacggaccatctatcaattcggcaggtactacccggtcatgtatgcgcaatggaggcaactccttctatgccgaactgaagtggctggtctcgggcactaagggtcagaacttcccgcagactactaatacataccgaaataccgacactgccgagcacctgattatctggggaattcaccatccctcgtccactcaagagaagaatgacctttatggcacacagagcctctcgatcagcgtgggctcctcgacttaccagaataactttgtcccggtaattggcgctaggcctcaggtgaacggccagtccggcagaatcgagttccattggactctggtgcgcccaggcgacaatatcacattcagccataatgggggtctgatcgcacctgaccgagttagtaaactgattggcaaggggatcgggatccaatcaggggctgtgatcgacaaagactgtgagtcaaagtgcttctggaggggcggaagcataattacggagctgccttttcagaacctgagcccaagaactgttggacaatgccctaagtacgttaagaagcgatctctcttgttggccactggaatgaggaacgtgccggaagtggttcaggggcgcggcctcttcggggctatagccggattcatagaaaacggctgggaggggatggtggatggctggtacggcttcagacaccaaaatgcgcagggcatcggccaggctgctgattacaagtctacccaaactgcgattgatcagatcaccggaaaactgaatcgactgatcgaaaaaactaacactgagttcgaaagcatcgaaagtgaatttagcgagattgaacatcagatcggcaatgtcataaattggaccaaggattccattacagatatttggacataccaggccgagctcctcgtggcaatggaaaatcagcatactattgatatggccgattcggaaatgctgaacctctacgaacgtgtccggaaacagctgcgccagaacgctgaggaggacggaaagggatgctttgagatttaccacacctgcgacaattcttgtatggagagtatacgcaataatacatatgaccattcacaataccgcgaagaagcccttctgaatcgtctcaatatcaatcccgtcaaactgtcctcagggtataaagacattatcctatggttcagttttggtgccagctgctttgtgctgctggctgtcatcatggggctgggctttttttgtctaaaaaacggaaacatgcggtgcacgatctgcatt

SEQ ID NO: 710 - DNA, 1683 bp, Influenza A virus
  misc_feature (1)..(1683): Codon Optimized Sequence Encoding H10 Hemagglutinin
atgtataagatcgtagtgatcattgcgctgcttggcgctgtcaagggcctagataagatatgtctcggacaccatgctgttgccaatgggacaattgtgaagactctaactaacgaacaggaagaagttacgaatgctacagaaactgtggagtccactggaatcaatagactctgtatgaaaggccggaaacacaaggatctgggcaactgccaccccattggtatgcttataggaacacctgcgtgcgatctgcacctcactggaatgtgggataccctcatcgagcgggagaacgcaatcgcgtactgttaccccggagctacggttaacgtcgaagctcttcggcagaagatcatggaatccggggggatcaataagatctctactggattcacatatgggtcttcaattaactccgctgggacgacccgtgcctgcatgaggaacggcggtaactctttctatgctgagctgaagtggctggtcagtaaaagtaaaggacagaactttccgcagaccaccaacacgtatcggaacactgatacagcagagcaccttatcatgtggggaatccaccatccctcttctacacaagaaaagaatgacctgtacggcactcagagcctttcaatctcagtgggcagttccacctatcgaaacaacttcgtgcccgtggttggagcacgcccacaggtgaacggccaatccgggcgcattgattttcattggaccctggttcagccaggggataacataactttcagtcataatggtgggctcatcgcaccaagccgtgtttccaagttaatcggccgggggctgggcatccagagcgacgctcctatcgacaataactgcgaaagtaaatgcttctggcgcggaggtagcatcaacacccgactacccttccagaatcttagcccacgaaccgtgggacaatgcccaaaatacgtcaaccgcaggtctcttatgctagctaccggtatgcgtaatgtccctgagctgattcagggccgcgggctttttggggccattgcaggatttcttgagaatggatgggaaggtatggttgacggatggtatggctttagacaccagaacgcgcagggcactggtcaagctgcagattacaagtccacacaggctgctatagaccagataacaggcaagctgaatagattagtggagaaaaccaacacagaattcgagagtattgagtctgaatttagcgagattgagcatcagattgggaacgtgatcaattggactaaagacagcatcacggacatctggacataccaggctgaacttttggtggccatggagaatcagcacacaatcgatatggcagactcagagatgctcaatttgtatgaacgggtgagaaagcaattacgccagaacgcggaagaggatggcaaaggctgctttgagatataccacgcatgtgacgactcatgcatggaatccatcaggaacaacacctatgaccattcccagtaccgggaggaagctctgttgaaccgcctcaacataaacccggtgacactgtctagcggttataaagatatcatcctttggttctcattcggggcgtcttgttttgttctccttgcagtggttatgggcctattcttcttctgcctgaagaatggaaatatgagatgtacaatctgtatc

SEQ ID NO: 711 - DNA, 1683 bp, Influenza A virus
  misc_feature (1)..(1683): Codon Optimized Sequence Encoding H10 Hemagglutinin
atgtataaagttgttgttatcatagcgctgctaggcgctgtcaaggggttagacaaaatttgtctgggccatcacgcagtggctaacggcacaatagttaagacattgaccaatgaacaggaggaggttacaaatgcaaccgagaccgtggaatcaaccggcattaatagactatgtatgaagggccggaagcataaggatctggggaactgccatccaatcggtatgctgatcggcacgccagcttgcgatttgcacctaacgggaacctgggacactttaatcgagagggagaatgctatagcttattgctaccccggcgctaccgttaatgttgaggcacttcggcagaagatcatggaaagcggggggatcgataaaatcagcacaggattcacctacgggagttctatcaactctgccgggactacacgtgcatgtatgagaaacggcggtaattccttctatgccgagctcaaatggcttgtttccaagaataagggccagaacttcccacagaccactaatacttacaggaataccgacactgcggagcacctcattatgtggggcatacatcacccttcttcgatccaagaaaagaatgacctctatggtactcagtccctcagcatatctgtggggagcagtacttaccggaataatttcgtacccgttgtgggagcacgcccacaggtgaacggccagtctggtagaattgatttccattggactttggtgcagccgggggataacatcaccttttcccataacgggggactgatcgctccaagcagagtttccaaacttattgggagaggtttagggatccagtcagacgccccaattgataacaactgtgagtcgaagtgcttttggagagggggcagcatcaatacgcggctgcctttccagaacctgtcacccaggactgtcggccagtgcccaaagtacgtgaacagacgatccttgatgcttgccaccggaatgcgtaatgtgcccgagctgatacagggccgtggacttttcggagccatcgcgggatttctggagaatggttgggaaggaatggtcgacggctggtatggattccgccatcaaaacgcccaaggaacaggccaggccgctgactataaaagcacgcaggctgctattgaccagatcacaggtaagctgaaccgcctggtcgaaaagaccaacactgaatttgagtccatcgagagcgagtttagcgaaatcgaacaccaaatcggcaatgtaatcaactggaccatggacagcataaccgatatttggacttaccaggcggaattactggtcgccatggaaaatcagcacacaatcgatatggcagacagcgaaatgttgaacctctatgagagagtcagaaaacaattgcggcagaatgctgaagaggatggcaaaggctgcttcgaaatctatcacgcatgcgatgatagttgcatggaatcaattcggaataatacgtatgaccatagccagtacagggaagaggcccttctcaaccgacttaatatcaatcctgtgacacttagttctggatataaggacattattctctggttctcttttggagcatcatgttttgtgctgctagccgtggtgatgggcctggtgttcttttgtctcaagaacggtaacatgaggtgtactatatgcatc

SEQ ID NO: 712 - DNA, 1683 bp, Influenza A virus
  misc_feature (1)..(1683): Codon Optimized Sequence Encoding H10 Hemagglutinin
atgtataaaatcgtggttattatcgccttgctaggggccgtcaaaggcctggacaagatctgtttgggccaccatgctgtggcaaatggcacaattgttaagacacttaccaatgagcaggaggaagtgaccaatgctaccgagaccgtcgagtctaccggcattaacaggctgtgtatgaaggggcggaaacacaaagacctgggaaactgccacccaatcggaatgctgattgggactcctgcttgcgacttacacctgaccggaatgtgggataccctcatagagagagagaacgcgatagcctactgttatcctggggcgaccgtgaatgttgaggccctgagacagaagattatggaatctgggggcatcaacaaaatttctaccggatttacatacggcagttccatcaactcagccggcacaacccgcgcgtgtatgagaaacggggggaacagcttttacgccgagctgaagtggctggtttccaaaagcaaagggcagaattttccgcagactacgaatacctacagaaatacagatactgccgaacacctcataatgtggggcatccatcatccgtccagtacacaggagaaaaatgacttatatggtacccagtctttatcaatttctgtaggctcctcaacttaccgtaacaatttcgtgcccgtggtcggagctcgcccgcaggtgaacggccagagtgggcgcattgactttcattggaccctcgtacaaccaggcgacaacatcactttttctcataatggtggtctcatcgccccaagccgagtctctaagctgattgggcggggtcttgggatccaatcagatgcacctatcgataacaactgcgaaagtaaatgtttttggcgtggcggttcaatcaacacccggctgccgttccagaacctgagtccaagaacagttggtcagtgccccaagtacgtaaaccggaggtctttgatgctggccaccggaatgcggaacgtgccagaactgatccagggccgaggccttttcggagccattgctggctttctcgagaacggttgggaaggaatggtagatggttggtacgggttcagacaccagaacgcccagggcaccggtcaggccgctgattataaatcaacccaggccgctatagaccaaatcaccggcaagctcaacagactcgtggaaaaaacgaatacggagttcgagagcatcgagtcagagttttcggaaatcgaacaccaaatagggaatgtcattaactggactaaggacagcatcaccgacatttggacatatcaggcagaattattagtggcgatggagaatcagcataccatcgatatggcagacagcgaaatgctcaatctgtacgaacgagtacgcaaacaacttcgccaaaacgcagaggaggatgggaagggctgcttcgagatataccatgcatgcgatgattcttgcatggagagtatccgtaacaatacatacgatcattcccagtaccgagaagaggccctgctgaaccggctgaatatcaacccagttacactctcatctggctacaaggatattatcctctggttcagttttggggcatcttgtttcgtcctgctagctgtcgtcatgggcctgttctttttctgtctcaaaaacggcaatatgcggtgtaccatatgcatc

SEQ ID NO: 713 - DNA, 1683 bp, Influenza A virus
  misc_feature (1)..(1683): Codon Optimized Sequence Encoding H10 Hemagglutinin
atgtataaaattgtggtcattatcgcccttcttggtgccgtgaagggacttgacaaaatctgcctgggccaccacgccgtcgcaaacggtactattgtgaaaactcttacaaatgagcaggaggaagtgacaaatgctaccgagaccgttgaaagcacaggtatcaacagactttgtatgaagggacgcaaacacaaggatctcggtaattgtcatccaatcggtatgctgatcggcactccagcatgtgacctccacctcaccggcatgtgggatactctaattgagagagagaacgcgatcgcttactgctatcccggtgcgactgtcaatgtggaagcccttcgacagaagatcatggagtcgggcggcattaacaaaatttctacaggtttcacctatggcagcagtattaactctgccggaacaacaagagcctgcatgaggaacggcggaaacagtttctacgctgaacttaaatggttggtcagcaagagcaaaggccagaatttcccgcagaccactaacacatatcgcaacaccgacaccgctgagcaccttattatgtggggaatacaccacccctccagcacccaggagaagaacgacttgtacggtactcagagcctctctatctccgtgggatcctccacataccgcaataactttgtccccgtggttggtgcccgcccccaggtaaacggacagtcaggcaggattgacttccactggaccctggtgcaacccggtgacaacattacattcagccataacggcggcctaatcgctccctctcgcgtgagtaaactgattggacggggactggggattcaatccgatgctcccatcgacaacaattgcgaatccaagtgcttttggcgaggagggtccattaacaccaggctgccgttccaaaacttgtctccccgtacggtggggcagtgtcccaaatacgttaaccgccggtccttaatgctcgctacagggatgagaaatgtgcccgagctgatccagggtagaggcctcttcggtgccattgctggattcctggagaatggatgggagggtatggtcgacggctggtacggttttcggcatcaaaatgctcagggaacaggacaggcggccgattataagagcacccaagctgctatcgatcagattacaggaaagctgaataggctggtcgagaagacaaacacggagttcgaaagtatcgaatcagagtttagcgagattgaacatcagattggcaatgtgattaattggaccaaggactcaattaccgatatctggacctatcaggccgagctgcttgtggccatggagaatcagcatacaatcgatatggccgattcagaaatgctgaacctgtacgagcgtgtgcgtaaacagctgcgccagaatgccgaggaggacggaaaggggtgttttgagatctaccacgcgtgtgacgactcatgtatggagagtatccggaacaatacttacgaccattcacagtatcgcgaagaggcattattaaaccgccttaatatcaaccccgtgacactcagcagcgggtataaggacatcattctgtggttctcatttggggcctcctgcttcgttctgctggccgtggtgatggggttattctttttttgtctaaagaacggtaatatgaggtgcacaatatgtatc

SEQ ID NO: 714 - DNA, 1683 bp, Influenza A virus
  misc_feature (1)..(1683): Codon Optimized Sequence Encoding H10 Hemagglutinin
atgtataaggtagtagtgatcatcgccctgctgggggccgtgagaggccttgataagatctgtttgggtcaccacgccgttgcaaacgggaccactgttaagacccttaccaatgagcaggaggaggtgacgaatgcaaccgagaccgtcgagtccacaagtctgaacaagctgtgtatgaaagggaggaggtataaagatctggggaactgccaccccatcggaatgttgattggaaccccagtctgcgatctgcacttgaccggcacctgggatacactgattgagcgggagaacgctaccgcctactgctatcccggggtcactattaatgaggaagccttgagacagaagatcatggagagtggagggatatccaagatgcggacagggttcacctacggtccctccatcaattccgctggcaccacccggtcatgcatgcgcaatggcggcaattccttttacgccgagctgaaatggctggttagcgggactaagggacagaacttcccacaaaccactaacacctatagaaatactgataccgcggagcatctgatcatatggggaattcatcatccttcatcgacccaggagaaaaacgacctgtacgggactcagtccctgtccatatccgtgggaagttccacttatcagaacaatttcgtgcctgttatcggagcccgacctcaggttaacggacaatcgggacggattgagttccactggactttagtgagaccgggcgacaacatcaccttttctcataacggcggcctgattgcccccgatagagtcagcaaattaatcggcaagggaatcggcatacagagcggggctgttattgacaaggactgcgaatctaaatgcttttggcgtggtggctccattatcactgaactgcccttccagaatctcagccctagaactgtgggccagtgcccgaagtatgtgaaaaagaggtctcttcttcttgctacaggtatgaggaacgtccctgaggttgtccaggggcgcggcttgttcggcgctatcgccgggttcatcgaaaacgggtgggaggggatggtggacggctggtatggctttcgacaccagaatgctcaagggatcgggcaggcagccgactacaaatccacccagacagctatagaccagatcacggggaaacttaatcgtctgatcgaaaagacaaatacggagtttgagtctatcgagtccgaattctcggagattgagcaccagattggtaatgtcatcaattggactaaggacagtattactgacatctggacttatcaagcagagctgctggtagctatggaaaaccaacatacaatcgatatggccgatagcgagatgctgaacctttacgaacgagtaaggaaacagctgaggcagaacgccgaagaggacggcaaaggttgctttgaaatttaccacacctgtgacaattcctgtatggaaagcatacgaaataatacctatgatcactcccagtacagagaggaagcgctcctgaaccgactgaatatcaaccccgtgaaactgagttccggatacaaggatatcatcctatggttctcattcggcgccagctgtttcgttctgttagcggttataatgggtctggggtttttttgtctcaaaaatggcaatatgcgttgtaccatttgtata

SEQ ID NO: 715 - DNA, 1683 bp, Influenza A virus
  misc_feature (1)..(1683): Codon Optimized Sequence Encoding H10 Hemagglutinin
atgtacaaggttgtggtcatcatcgccctgcttggtgctgtgaaagggcttgataagatatgtttgggccaccatgccgtggctaacggaaccattgtgaagaccttgaccaacgagcaggaggaagtgactaatgccacagaaactgtagagtctaccggtataaacaggctgtgcatgaagggaaggaagcacaaagatctcggcaattgtcatcccataggcatgctgatcggtacccccgcctgcgatctgcacttgactggcacctgggacacgctgatcgagagggaaaacgctatagcctattgttaccctggggctaccgttaatgtggaagcgctgcgacaaaagataatggagagcgggggcattgataaaatttcaaccggatttacctacggctctagtatcaactctgcgggtactacgcgagcatgcatgagaaacggggggaattccttttatgcagagcttaagtggctggttagcaagaacaagggtcagaatttcccccaaactactaacacttacagaaacacagataccgccgaacatctgatcatgtggggcattcatcacccatcctctattcaagagaagaatgacctttatggcactcaaagcctctctatctccgtgggaagcagcacttaccgcaataatttcgtgcccgtcgttggggcacgaccgcaggtcaatggccagagtggcaggatcgatttccattggaccttagtccagccgggcgataatattaccttcagccataacggaggacttattgcgccgtccagagtgtcaaaactgatcgggagaggactcggcatccagagcgatgctcctattgataataattgcgagtccaagtgtttttggcgtgggggttcgatcaatactagactacctttccagaacttgagcccacgcactgtgggccagtgccccaaatatgtaaatagaaggtcccttatgctcgctacaggtatgaggaacgtcccagaactcattcagggccgaggtttgtttggcgcaatcgccggatttctggagaacgggtgggagggcatggtcgacggctggtacggattccgccaccagaacgcccaaggtacaggtcaggccgccgactataagagcacgcaggctgctatagatcagattacaggaaagctaaaccgacttgtggagaagacaaatacagagttcgagtcaatagagagtgagttcagtgagatagagcatcagatcggtaatgtcattaactggacaatggatagcatcaccgatatttggacttatcaggccgaattgctggtggctatggaaaatcagcacaccattgatatggcagactctgagatgctaaatctttacgagcgggtgcgaaagcagttgcggcagaacgcagaagaagacggaaaaggctgcttcgaaatatatcacgcttgcgacgattcctgtatggaaagcatcagaaataacacatatgaccacagtcagtatcgcgaggaggctctcctgaacagactcaatatcaatccggtcaccctctcctcaggttacaaggacattattctctggttttctttcggtgcgtcttgctttgtgctactcgctgtggtgatgggcttggtgttcttctgcctgaagaacggcaatatgcggtgcactatctgtatc

SEQ ID NO: 716 - DNA, 1683 bp, Influenza A virus
  misc_feature (1)..(1683): Codon Optimized Sequence Encoding H10 Hemagglutinin
atgtacaaaattgtggtcatcatcgctttactaggagctgtgaaaggcttggataaaatttgtctgggacatcatgctgtcgctaacgggaccatagtgaaaacactcacgaacgaacaggaggaagttaccaatgccaccgaaacggtcgagtcaacagggattaaccggctgtgtatgaagggaagaaagcataaagatctggggaactgccaccctataggaatgttgataggcacgcctgcttgtgacctgcacctgactgggatgtgggataccctgatcgaaagagagaacgctatagcctattgctatcccggtgcaacagtgaacgtggaggcattgagacagaaaataatggaaagtggagggatcaataagatctcaaccggttttacctatggatctagtataaatagtgcagggaccacacgtgcctgcatgagaaatgggggcaattctttctacgcggaactgaagtggctggtgagcaaatctaaggggcagaattttccacagaccacgaatacatatcgtaacacagacaccgcggagcacttgattatgtggggtatccaccaccccagcagcacgcaggaaaaaaacgatctctacggtactcagagcctgtctatctcagtaggctcatcaacataccggaataactttgttccagttgtgggggcccggcctcaggtgaatggccagtctggacgcattgattttcattggacgctggtacagccaggagacaatatcacatttagtcataatggcggtttgatcgccccgagtagagtgtctaagctgatcggccgaggccttggcattcagtccgacgcccccatcgacaataactgcgaaagcaaatgcttttggagaggaggttctattaatacacgcctgccatttcaaaacttgagccctagaactgtgggtcagtgtcccaagtacgtgaatcgccgctccctgatgttagccaccgggatgaggaatgtgcctgagctgatccagggcaggggcctatttggagccatcgctggtttcttggagaatggttgggagggtatggtagatggatggtatgggtttcggcatcagaatgcgcaaggcactggccaggccgcggattacaaaagcactcaggctgccattgaccagataaccggaaaactcaacagactggttgagaagaccaacactgaatttgagagcattgagtcagagtttagcgaaatagaacaccagatcgggaacgttattaactggacaaaggactccattacggacatatggacatatcaggcagagctgctagtggcaatggagaaccaacacactattgacatggccgactctgagatgctgaacctctatgagcgcgtcagaaagcagctaaggcagaatgcagaagaggatggtaaagggtgttttgaaatctatcatgcatgcgacgattcatgcatggaaagcatcaggaacaatacttatgaccattcccaataccgagaggaagccctgctgaacagactgaatattaacccagtgaccctatccagtggctataaggatatcatcctgtggttcagctttggcgctagctgtttcgtgttactcgcggtcgtcatgggactgttttttttttgtttgaagaacgggaatatgagatgcacaatctgtatt

SEQ ID NO: 717 - DNA, 1683 bp, Influenza A virus
  misc_feature (1)..(1683): Codon Optimized Sequence Encoding H10 Hemagglutinin
atgtataaaatcgtagtgattattgcgttgcttggcgctgtgaaagggctagataagatctgcctgggccaccacgccgtagctaacggaaccatcgtcaaaactttgactaacgagcaggaagaggtcaccaatgctactgagacagtcgagtctacaggcataaatagactctgtatgaagggtagaaagcacaaggatcttgggaattgccaccccattggtatgctgattgggacacccgcctgcgacctgcacctcacagggatgtgggacaccttaattgagcgagagaatgcaatcgcctactgttaccccggggctactgttaacgtcgaagctctgcgccagaaaatcatggagagcggggggatcaacaagatctccaccggcttcacctatggctcatctatcaattctgcaggcactaccagagcgtgcatgagaaatggaggaaattccttctatgcggaattgaaatggcttgtgtcaaaatctaaagggcaaaattttccgcagaccaccaacacctacaggaacaccgatactgcagagcatctgattatgtgggggattcaccacccttcatccactcaggaaaagaacgatctctatgggacacaatcattgtccattagcgtgggctcttccacttacagaaacaacttcgtgcctgtcgttggggcgcgaccgcaagttaatgggcaatccgggcgaattgatttccactggacgctggttcaacctggagacaatatcactttctcacataatggagggttaattgctccctcccgcgtctccaaactgattggaagaggcctgggcattcagtccgatgccccaatcgacaacaattgcgaatccaagtgtttctggcgcgggggctcaatcaatacccgcctgcccttccaaaacctgagtccccgcacagtgggccaatgccctaaatatgtcaaccgtcgatccctcatgcttgccacaggcatgaggaacgtcccagagctgatccagggccgcggactctttggagctatcgcaggctttcttgaaaacgggtgggagggcatggtcgatggttggtatggatttcggcatcagaatgcacaaggtactggacaggccgctgattacaagtcaacccaggcggccattgaccagataaccgggaagctcaaccggttggtcgagaagactaatactgagtttgaatccatcgaaagtgagttctctgagatagaacatcagattggtaatgtcataaattggactaaagatagcataacggacatttggacctatcaggcagaattactggtggcaatggaaaatcaacacaccatcgacatggccgattctgaaatgctcaacctatacgaaagagtcagaaagcagctcagacagaacgccgaggaagacggcaaagggtgctttgaaatttaccatgcttgtgacgattcttgtatggagagtatacgcaataacacttatgaccattcacagtaccgagaggaggcactcctgaatcgactgaacatcaaccccgtcacactgtcctcaggctacaaggatattatcctttggtttagttttggtgcgtcgtgcttcgtcctcctggccgtcgtgatggggttattctttttttgcttgaaaaatggaaatatgcgttgcaccatctgtatc

SEQ ID NO: 718 - DNA, 1683 bp, Influenza A virus
  misc_feature (1)..(1683): Codon Optimized Sequence Encoding H10 Hemagglutinin
atgtataagatagtcgtcataatcgctctgctcggcgcagtgaaagggctggataaaatttgtctgggtcaccacgccgtagcgaatggcaccatcgtgaagacactgactaacgagcaagaggaggtgactaatgccacagaaaccgtcgagtctacaggaattaaccgcctctgcatgaaaggcaggaaacacaaagatctcggcaactgtcacccgatcggaatgctcatagggactccagcctgtgatctccaccttaccggaatgtgggatactctcatagagagggagaatgccatcgcttattgttaccccggcgcgacagttaacgtggaagctctcagacagaagatcatggaaagtgggggcattaacaagatatccaccggattcacttacggttcatccattaattctgcgggaaccactcgggcctgtatgcggaacggtggcaattctttctatgccgagctgaagtggctggtctccaagtccaagggccagaatttcccacagactaccaacacatatagaaacactgacactgccgagcatctgatcatgtgggggatccatcacccaagttcaactcaggagaagaatgacctctacggtacccagagcttatctattagtgttggctcctctacttaccgcaataattttgtgccagtagtcggtgctcgccctcaggtgaatgggcagtccggcaggatcgacttccactggactctagtccaacccggggataacatcacattcagtcataacgggggattgatcgctccaagtagagtttcaaaactcataggtaggggcctcgggattcagtcggacgctcctatcgacaacaattgcgagtctaagtgtttctggcgagggggaagcataaatacccgactccccttccagaatctcagcccaaggactgtgggtcagtgcccaaaatacgttaaccgccggagcctaatgctggcgactggcatgagaaacgtccccgaactgattcaaggtcgcggactcttcggggcaatcgcgggatttctggaaaacggctgggagggaatggtggacggctggtacggcttccgacaccagaacgctcaagggacaggccaagcggctgactacaagtccacccaggccgcgattgaccaaatcacagggaaattgaataggctggtagaaaagacgaatacagagttcgaatccatagagagtgaattttccgagatcgaacaccaaataggaaatgtcatcaattggacgaaggacagcattacggacatctggacataccaggcagagctcctcgtggcgatggaaaatcagcacacaatcgacatggctgactcagagatgctcaatctgtacgagcgggtccgcaaacagttgaggcagaatgctgaagaagacggtaaagggtgttttgaaatctatcatgcctgcgacgattcatgcatggaatctattagaaacaatacgtacgatcactcccagtatagggaggaagctctgctgaatagactgaacataaaccccgtcaccctgtcttccggttacaaggacatcatactttggttctcgttcggtgcaagctgcttcgttctgctcgctgttgtcatgggcctgttcttcttctgtttgaaaaacggcaatatgcgatgcaccatttgtatt

SEQ ID NO: 719 - DNA, 1683 bp, Influenza A virus
  misc_feature (1)..(1683): Codon Optimized Sequence Encoding H10 Hemagglutinin
atgtataaaattgtcgtaatcattgccctgctgggagcggttaaggggcttgataagatatgcttggggcatcacgccgtagctaatggtacaatcgtcaaaacactaactaatgaacaggaggaagtaacaaacgcaactgaaactgttgagtctacgggaatcaacaggctctgtatgaaaggccgaaagcacaaagacttgggtaattgtcacccgatcgggatgctcatcgggacacctgcatgcgacctccacctcaccggcatgtgggatacacttattgaacgggagaacgcgatcgcctactgctaccctggggcaacggtgaatgtagaagctctccggcagaagatcatggaaagcggcggaattaataaaattagtaccggatttacctacgggtcatccataaacagcgccgggaccacacgcgcctgcatgaggaacggcggcaacagcttttatgccgagctcaagtggcttgtctccaaatccaaaggacagaactttcctcagacaacgaacacatatcgtaatactgataccgcagaacatctgatcatgtggggaatccaccaccccagtagcacccaagagaagaacgatctatacggaactcagtctctttccatcagcgttgggtcctctacttacaggaacaattttgtaccggtcgtgggagcccgcccccaggtgaatgggcagtccggaaggattgattttcactggactttagtacagcctggagacaacataaccttttcccacaacggaggtctcatagccccttctcgagtgagcaagttgatagggcgtgggttgggaatccagtctgacgctccgatcgacaataattgtgagtccaagtgcttttggaggggcggctctatcaatacgagattgcctttccagaaccttagtccaagaaccgtggggcaatgtccaaagtatgtcaatcgacgctcactaatgttagcaaccggcatgaggaatgttcccgagctaatccaaggccggggactctttggcgccatcgcgggcttcttggagaacggttgggaaggaatggtcgacgggtggtatggcttccggcaccaaaacgcccagggtacaggccaggcagccgactataaatccacacaggcagccatcgatcagatcaccggcaagctcaataggctcgtggaaaaaacaaacactgagttcgagtccattgaatccgagttctcggagatcgagcaccaaatcgggaacgtcatcaattggactaaggacagtattacagatatctggacatatcaggccgaacttttggtcgctatggaaaatcaacatacgattgacatggcagactcagagatgttaaacctgtatgagagagtgcgcaaacagctgcggcagaatgccgaagaagatgggaagggatgtttcgagatttaccatgcctgtgacgattcctgcatggagtcgattcgtaataatacttatgatcattcccaatatagagaggaagcattattaaaccggctgaatattaaccccgtgaccctgagctccgggtacaaggacattattctgtggttctcattcggcgcatcttgtttcgtcttactcgcagtggtcatgggactgtttttcttttgtctgaagaatgggaacatgcgctgtaccatttgtatc

SEQ ID NO: 720 - DNA, 1683 bp, Influenza A virus
  misc_feature (1)..(1683): Codon Optimized Sequence Encoding H10 Hemagglutinin
atgtacaagattgtcgtcatcatagccctcctaggtgctgttaaagggctcgataagatctgccttggacatcacgccgtggcaaatggaacaatagtaaagacactcacaaacgagcaggaagaagtgacgaatgccaccgaaaccgtcgagagtaccggcatcaacagactgtgcatgaagggcaggaagcataaagacctgggcaactgccaccctatcggcatgctaatcggtacaccagcctgcgatttacacctgaccggaatgtgggacacactgattgaacgagaaaatgccattgcttactgttatcctggcgctaccgtgaatgtggaggctctcaggcagaaaattatggagagtggggggatcaacaagattagtactggctttacctacggctctagcatcaactctgctggcacaacgcgcgcttgtatgagaaatggcggcaattcattctacgccgagcttaagtggctggttagcaagtccaagggacagaactttcctcaaacgacgaatacataccgcaacaccgatactgctgagcatctgatcatgtggggcatccatcatccctcctcaactcaggaaaaaaatgacctctacgggactcagtccctatcaatctccgttggtagtagcacttatcggaacaactttgtgcctgtggtgggcgctagacctcaggtcaatgggcagtctgggcggatcgactttcactggactctcgtacaacctggtgacaacataactttctcacacaatggcggcctcatcgccccaagccgagtcagtaaattaatcggccggggtctgggcatccagagcgacgcaccaattgataacaattgtgaatccaaatgcttctggcggggcgggagcattaacactcggttaccctttcagaacttgagtcctcgcaccgtgggacaatgcccgaagtacgtgaaccgccgctcactcatgctggcaaccggcatgcggaacgtccccgaactcatccagggcagagggctctttggcgccatcgctggatttctggagaacggatgggagggcatggtcgatggctggtacggcttcaggcatcagaacgcccaggggaccggccaagccgctgattacaaatctactcaggctgccatagaccaaatcacagggaagcttaatcgcctggtggaaaagaccaatacagaatttgaaagcatcgagtctgagttcagtgaaattgaacatcagatcgggaacgtgatcaattggaccaaagacagcattaccgatatttggacctaccaggcagagttgctcgttgccatggagaaccagcacactattgatatggccgactccgagatgctgaatctctatgagagggttcgcaaacaactgagacaaaatgcggaagaagatggaaagggctgttttgagatctatcacgcctgcgatgatagttgcatggaaagtatcagaaataacacatacgatcactctcagtaccgggaagaggccctcctgaacaggcttaatattaaccccgtgacgctttcatctggctataaggacatcattttgtggttctcatttggcgccagctgctttgtgctgctggctgtagttatgggcttattcttcttctgcctgaagaacggaaacatgagatgtaccatttgcatt

SEQ ID NO: 721 - DNA, 1683 bp, Influenza A virus
  misc_feature (1)..(1683): Codon Optimized Sequence Encoding H10 Hemagglutinin
atgtataaaattgtggtcataattgccctgcttggggcagtgaaggggttagacaaaatttgcttggggcaccacgcagtggccaacgggacaattgtcaaaacactgacaaatgaacaggaggaagtgacaaacgccacagaaaccgttgaatcaaccggaatcaatagactttgtatgaagggcagaaagcacaaagatttgggcaattgccatccaattggaatgttgatcggcacccctgcctgtgacctgcatctgactgggatgtgggacaccctgatcgaacgggagaacgcaattgcgtactgttatcccggcgctacagttaatgtggaggccctccgacagaagatcatggagagtggcggcattaacaagataagcaccggcttcacctatggctccagcataaactcagctggcactactcgggcatgcatgaggaacggcgggaactccttctacgctgaactcaagtggctggtgtcgaaatctaagggacagaacttcccgcaaaccaccaacacttaccggaatacggacacagcagagcatctgatcatgtggggcatacaccatccatccagcacgcaggaaaaaaacgacctgtatggaacacagagcttgtctatctcggtggggagcagcacctacaggaacaatttcgtccctgttgttggagccgggccccaagttaatggccagagtggcagaatcgactttcattggacactggtgcagcctggagataatattacttttagccacaacggtggactcattgctcccagtagggtctcgaagttgatcggtcgtggcctgggtattcagagcgacgctcccattgacaataattgcgagagcaaatgtttctggcggggaggtagtattaatactaggctccctttccagaatctgtcaccgcgcaccgttggccagtgtccgaaatatgtcaaccggcgatccctaatgctagccactggcatgcggaacgtccctgaactcattcaaggcaggggactgttcggcgctatcgctgggtttctggaaaatggatgggagggcatggttgatggctggtatggcttcaggcaccagaacgctcagggcaccgggcaagccgccgattataaatccactcaggcggccatcgatcaaataactggcaaactaaataggctggtcgaaaagacaaacactgagtttgagagcattgagagcgaattttctgaaattgagcaccagatcggtaacgttattaactggaccaaggattcaattacagatatttggacctaccaggcagagcttctggtcgccatggaaaaccagcacacaattgatatggccgacagcgaaatgttgaacctttacgagagagtgcggaagcagttgagacagaacgctgaggaggatgggaaagggtgcttcgagatttaccatgcctgcgatgattcttgtatggagagcatcaggaacaatacctatgaccacagccagtatcgcgaagaggccctgctgaacagactgaacatcaaccccgtgacactctcttctggctataaggatataatcctgtggtttagcttcggagccagctgctttgtccttctagcagttgtcatggggctcttctttttctgcctgaagaatggaaacatgagatgtacaatttgcatt

SEQ ID NO: 722 - DNA, 1683 bp, Influenza A virus
  misc_feature (1)..(1683): Codon Optimized Sequence Encoding H10 Hemagglutinin
atgtacaaagtggtggtcatcattgccttgttgggtgctgtccgggggttagacaagatctgtctggggcatcacgccgtagccaatggaactactgtcaagaccttaaccaacgagcaagaagaggtcacaaatgcgacggagaccgtggaaagcacatcgcttaataagctgtgcatgaaggggcgtcgctacaaagatctgggaaattgccatccaatcggcatgctgattggaactcccgtctgtgatctacacctgactggaacttgggatactttgattgaaagagagaacgctacggcttactgttatccaggggtaaccatcaatgaggaggccctgcgtcagaagattatggagagtgggggaatcagcaaaatgcggacaggattcacctatgggccgtccattaattctgccggtaccacgagaagctgcatgcggaacggtggaaactcgttttacgcagaactgaaatggttggtctctggcacgaaaggacagaacttcccacagactacaaacacctatcgaaataccgataccgccgagcacctgatcatttgggggatccaccaccctagcagcacccaggaaaaaaatgacttatatggcactcaatccctgagcatctctgtgggctcctctacttatcaaaacaattttgtgcctgtgattggagccaggccccaggtgaatggacaatccggacgcattgagttccactggacacttgtcagacccggggataatatcaccttttctcacaacggcggtcttatagcgccagaccgtgttagcaagctgattggcaaggggatcggcatccaatcaggtgctgtgatcgacaaggattgtgagtctaagtgcttttggaggggtgggtccatcattaccgagctgccttttcagaacctaagcccacgcaccgtcggacagtgccccaaatatgtgaaaaaaagatctttactgttggccaccggaatgagaaatgtgccagaggtggtccaaggtcggggcttgttcggggcgattgcaggctttatagagaacggctgggagggcatggtggacggttggtacggtttccggcaccagaacgcacagggaattgggcaagccgccgactacaagtcaacccaaacagccatagaccagattacgggaaaactgaacagattaatcgagaaaactaatacagaatttgagagcatcgaatctgagttttccgaaatcgagcaccagatagggaatgtcatcaattggactaaggactccattacagacatctggacttaccaggccgagttgctggtcgccatggagaatcagcatacaattgatatggctgacagcgaaatgctcaacctgtacgagcgcgtaaggaagcaactgcgccagaatgctgaggaagacgggaagggttgctttgagatttaccacacctgtgacaactcatgtatggaaagcatccggaacaacacttacgatcactctcaatatcgcgaggaggcccttctgaatcggctgaatataaacccagttaaattgtcttcaggctataaagacatcatcctgtggttctcgttcggggctagctgtttcgtgctgctggccgtgataatgggccttggattcttttgtctcaagaacggcaatatgaggtgcaccatatgtatc

SEQ ID NO: 723 - DNA, 1683 bp, Influenza A virus
  misc_feature (1)..(1683): Codon Optimized Sequence Encoding H10 Hemagglutinin
atgtacaaggtcgttgttatcatcgccctgttgggcgcggtgaggggactcgataagatttgtctgggccaccacgccgtcgccaacggcacgactgtgaagacattgaccaacgagcaggaggaggttactaatgccaccgaaactgtggagagtaccagtctgaacaagttgtgcatgaagggccggcggtataaggatctgggaaattgccaccccatcggaatgctcattggtaccccagtgtgtgatcttcacctcacaggaacctgggataccctcatcgagcgtgagaacgcaaccgcgtattgctatcccggcgtgaccataaatgaggaagccctgagacagaagatcatggagagcggcggcataagtaagatgaggaccggcttcacttatggcccctcaattaacagtgcgggaacaacccggtcctgcatgagaaatggcggcaatagtttctatgctgaactgaagtggcttgtgagcggaacaaagggacagaattttcctcagacaacgaacacgtatcgcaacactgataccgctgaacacctgatcatctggggcatccatcatcccagttctactcaggagaaaaatgacttgtatggtacccaatctttgtctatatccgtcgggagttccacataccagaacaacttcgtccctgtgattggggcgcgacctcaagtgaacggccagtcgggccgcatagagtttcactggaccttggtccgaccaggcgataacattacattttcgcacaatggcggcttgatcgcccccgatcgcgtgagcaaacttatcgggaaggggatcggaatccagagcggcgcagtgatagacaaggactgcgaaagcaaatgcttctggcgcggtggatctatcatcactgaattgcctttccaaaacctgtccccccgaacagtgggtcagtgcccgaagtatgtgaagaagcgcagtttgctattagcgactggcatgcggaacgtgcctgaggtggttcaggggcgcggtctctttggcgccatcgcaggatttattgagaatggctgggagggcatggtcgacggctggtacggatttagacatcagaatgctcagggaattgggcaggccgccgattacaagagtacccagacagcaattgaccagatcacaggcaaacttaacaggcttattgagaaaaccaacaccgagttcgagtccatcgagtcagagtttagcgagatcgaacatcaaatcggcaatgtgattaattggacaaaagattctattaccgatatctggacctaccaggcagagctgctggtggctatggaaaaccagcacaccatagacatggcagacagtgagatgctgaacctatatgagcgtgtgaggaaacaattgagacaaaatgccgaggaagacgggaagggatgcttcgaaatataccacacatgtgataactcctgtatggaatcaattcggaacaatacttacgaccacagccagtatcgcgaggaagccttacttaatcgtttaaatattaatcccgttaagctgagctccggttataaagacatcattctgtggttctcctttggagccagttgcttcgttttgctcgccgttatcatgggcctggggtttttctgtctcaagaatggaaatatgcgatgcaccatttgcatc

SEQ ID NO: 724 - DNA, 1683 bp, Influenza A virus
  misc_feature (1)..(1683): Codon Optimized Sequence Encoding H10 Hemagglutinin
atgtataagattgtcgtgattatcgctctccttggtgccgttaagggcctggacaagatctgtcttggacaccacgctgtggccaatggcactattgtcaaaaccctcactaatgagcaggaggaggtcaccaacgcaacggagacagtagaaagcaccgggatcaaccgtctgtgcatgaaggggcggaaacataaagacctcggaaactgccatccgattggaatgctgatcgggaccccagcttgcgacctccatctgacagggatgtgggacacgcttatcgaacgcgagaatgccattgcctattgttatcctggggctactgtgaacgtagaagccctgcgtcagaagattatggagtccggcgggatcaataaaatcagcacagggttcacctatggctcttcaatcaacagtgccggaacaacccgcgcctgcatgcggaacggcgggaattccttctacgccgaattaaagtggttggtttctaaaagtaaagggcaaaacttccctcagaccacgaacacctatcgtaacacagacaccgccgagcatctcatcatgtgggggatccaccatcccagcagtacacaggaaaagaatgatctgtacggcacacagtcgctgtcgatctcagttgggagtagcacttaccgcaacaactttgtgcccgtcgtgggggcgaggccgcaggtaaatgggcaatctggacgtatagacttccactggactctagtgcaacccggcgacaacatcacattttctcataacgggggccttatagccccgtctcgagtgtccaaactgattggccgcggcctcggaatccagtccgatgcccccatcgacaataattgcgagtctaaatgtttttggcgaggggggagcattaacacacggctcccatttcaaaatttgagtccgcgcaccgtcggtcagtgtccaaaatatgtgaacagacgcagcttgatgctcgcaacgggcatgagaaacgttcctgaattgatccagggtcggggactgtttggggccatcgcaggctttttggagaacggttgggaaggaatggtggacggatggtacggctttagacaccagaacgcacagggaaccggtcaggcagctgactacaagtcaactcaggccgccattgaccagatcacaggcaagctgaatcgactcgtcgagaagaccaacaccgaatttgagtctatcgaatcagagttttcggagatcgagcaccagatcggcaatgtgatcaattggacaaaggattctatcaccgatatctggacgtatcaggcggaattgctggtagccatggagaatcaacacacaatagatatggccgattctgagatgcttaacctgtacgaacgggtccggaagcaactccgccagaatgcagaggaggatgggaagggctgcttcgagatttaccacgcttgtgatgactcctgcatggagtcaattcgaaacaacacttacgatcactcacagtaccgcgaggaagcacttcttaataggctgaacatcaatcctgttactctctccagcggatataaagatatcattctgtggttcagcttcggtgccagctgctttgtgctactggcagtggtcatggggctcttcttcttctgccttaaaaatgggaatatgcgttgcaccatttgcatt

SEQ ID NO: 725 - DNA, 1683 bp, Influenza A virus
  misc_feature (1)..(1683): Codon Optimized Sequence Encoding H10 Hemagglutinin
atgtataaagtggtagtgatcatcgctctgctgggtgccgtgcgaggccttgataagatctgtcttggccaccatgcagtggccaacgggaccatagttaagacattaaccaacgaacaggaggaggttaccaacgctaccgaaactgtcgagagcaaatctctgggtaagctgtgtatgaagggccgtagctacaatgatcttggtaactgtcatcctatcggcatactaattgggaccccagcctgtgacttgcaccttactggtacttgggacaccttgatagaacgtgaaaatgccgtggcttactgttacccgggcgccactgtgaacgaggaggccctgcggcagaaaattatggagtcaggtggcatctctaagatttcaacaggcttcacctacgggacaagtattaattcagctgggactaccaaagcctgtatgcgaaatgggggtaactctttttatgccgagcttaagtggctggtttctaaaaataaaggacagaattttccacaaactacaaacacttatcggaacacggacaccgccgagcacctgattatttggggaatccaccatccatctagcactcaggaaaaaaatgatctgtatggtactcagagcctgagcattagcgtaggcagctctacatatcagaataactttgtgcctgttgtaggggctaggcctcaagtgaacgggcagagcggtaggattgatttccactggaccctgttgcagcccggagacaatataaccttctcgcataacggagggctgatagccccgtccagagtgagtaagctgatcggtagaggactgggaattcagagcgaagccccaattgataacggctgcgagagtaagtgcttctggaagggcggtagcattaacacgaagttgccatttcagaatctcagtccacgtacggtgggccagtgtcccaaatacgtcaacaaacgctctctgatgcttgctactgggatgaggaatgtccccgagataatgcatggacgcgggttgtttggcgccatcgccgggtttattgagaatggctgggagggcatggtagatggatggtacggttttcggcatcagaatgcccaggggaccggacaggctgcggattacaagtctacacaggcagccatcgatcagatcacaggcaagttgaaccgactgatcgaaaagacaaacacagagttcgaatcaattgagagcgagttttccgagatagagcatcagattggcaacattattaattggactaaagatagcattaccgatatatggacctatcaggcagaactgctcgtcgcaatggagaatcagcacactatcgatatggccgattcagagatgctaaacctgtacgaacgcgttcgcaagcaactcagacagaatgctgaggaggatggcaagggttgtttcgagatctaccatgcgtgcgacgatagttgtatggagagcattcggaataatacctacgatcactcccagtacagggaagaggctttgttaaatagactgaatataaaccctgtcaagctatcatcaggttacaaagacatcattctttggttctcttttggcgcttcctgtctgatccttctagccgtggtgatgggtctggttttcttttgcctcaaaaatggaaacatgcgttgtacgatatgtata

SEQ ID NO: 726 - DNA, 1683 bp, Influenza A virus
  misc_feature (1)..(1683): Codon Optimized Sequence Encoding H10 Hemagglutinin
atgtataagatagttgtgataattgcgctgttgggggccgtgaagggactcgacaaaatctgcctcggccaccatgcagtcgccaacggtactattgtgaaaaccctaaccaacgaacaggaggaggttactaatgccaccgagactgtcgaatcaaccggcatcaaccgcctctgtatgaaaggccgcaaacacaaggatctgggaaactgccaccccatcggcatgttaataggcacccccgcatgcgatctgcacctgacaggaatgtgggacaccttgatcgagcgtgaaaacgcgatcgcttattgttaccctggcgcgactgtgaatgtcgaggctctgagacagaagattatggaaagcggtggcattaataagattagtactggatttacttacggttccagcataaattctgcagggaccactcgcgcgtgcatgcgcaatggtggcaatagtttctacgctgaacttaagtggcttgtatctaagtcgaagggacaaaattttccacagacgaccaacacatataggaacacagatacagcagagcaccttatcatgtggggcattcatcatccgagcagtactcaggagaagaacgacctgtacgggactcagtctttgagcattagcgtgggaagcagcacttaccggaacaattttgttcctgtagtgggcgctcgtcctcaggtcaatgggcagtcaggacggatagactttcactggacactcgtgcagcccggcgataacattactttttcacataatgggggtctgatagcaccaagtcgcgtctctaaactgattggtaggggcctgggaattcagtccgacgctcccatcgacaataattgcgaatccaaatgcttttggcggggagggtctattaacaccaggttgccatttcagaatctgtccccgcggacagttggccagtgccccaagtatgtcaaccgcaggtccctgatgctcgctacaggaatgcgcaatgtgccagagttgatccagggacggggcttgttcggtgcaattgcaggctttctggaaaacggctgggaggggatggtcgatgggtggtacggctttcgccaccagaacgcccagggaacaggccaggccgccgattacaaatctacccaggctgccatcgatcaaattacagggaaattaaaccgactagtcgagaagaccaacactgaatttgaatccattgaatctgagttttctgagatagagcaccagattggaaatgttattaattggacaaaggatagcatcacagacatatggacataccaagccgaattgctcgtggcgatggaaaaccagcacacaattgatatggccgacagcgaaatgctaaacctttacgagagagtccgaaagcagctaaggcagaatgccgaggaagacggtaaaggctgtttcgaaatctaccatgcatgcgacgattcatgcatggaaagtatacgcaacaatacctatgatcattcccagtaccgcgaagaggccttgctgaaccgactcaacatcaaccctgtaaccctgagttctgggtataaggacatcatcctgtggtttagttttggagcatcgtgctttgtgctgctcgctgtggtgatgggattgttcttcttttgcttaaagaacggcaacatgaggtgcaccatctgtata

SEQ ID NO: 727 - DNA, 1683 bp, Influenza A virus
  misc_feature (1)..(1683): Codon Optimized Sequence Encoding H10 Hemagglutinin
atgtataagattgtcgtcatcatcgccctactgggcgcggtgaaagggctagataagatatgtctcgggcaccatgcagtggctaacggaacaattgttaaaaccttaacgaatgaacaggagaaggttaccaacgctactgaaacagttgagtcaactggcctcaacagactgtgcatgaagggtcgcaaacacaaagatttaggcaactgccaccccattggtatgttaatcggaaccccagcctgtgatctccatctgaccggcacatgggatacgataattgagagggagaatgctattgcctactgttaccctggcgccaccgtcaatgaagaggccctcagacagaagatcatggagtccgggggtatcgacaaaatttccaccggtttcacctacggtagctccatcaatagtgccggcactacacgcgcatgcatgcgcaatgggggcaactcattctacgcggagctaaagtggctcgttagtaagagcaaaggacagaacttcccacagactactaacacttataggaacactgatacggcagaacatttaattatgtggggcatacaccatcctagctcaacgcaggagaagaatgacctatacggtacccaatccctctccatcagtgtggggagctctacttatagaaacaacttcgtgcccgtcgtaggcgctcgacctcaggtcaatggacagtctggcagaatcgacttccactggactctggtacaacctggcgataatattacctttagccacaatggcggcttaatagcaccatctcgtgtgagcaagttgattgggcgaggattgggcattcagtcggacgcgcccattgataacaactgtgaatccaaatgcttctggcgtggagggtcaatcaatacccgcctccccttccagaacctgtccccgaggactgtgggccaatgtcccaaatatgtgaacaagaggtctctgatgctggcaaccgggatgagaaatgtgcccgaactgatccagggacgcgggctattcggggctatagcaggttttctcgaaaatggatgggagggcatggtggacgggtggtacggctttcgccaccagaatgcacagggaaccggccaggccgcagattacaaatccacccaggcggccatcgatcagataaccggcaaattgaacaggctggttgaaaaaacaaatacagaattcgaatccattgagtctgagtttagcgagatagagcaccagataggcaatgtcataaactggaccaaagattccattacagatatctggacatatcaggcagagctgctcgtggcaatggagaatcagcatactattgatatggcagacagcgagatgctcaatctgtatgaacgggtaaggaaacagctgcgtcagaatgctgaggaggacggtaaggggtgttttgaaatataccacgcttgcgatgacagttgcatggaatctattcgcaacaatacgtacgaccactctcagtaccgcgaggaggcccttcttaacaggctgaacattaatcccgtcacactaagctccggttataaggacatcattctttggttttcatttggcgctagctgcttcgttctgcttgccgtggttatgggcctggtctttttctgccttaagaacggaaatatgaggtgtacaatctgcatt

SEQ ID NO: 728 - DNA, 1683 bp, Influenza A virus
  misc_feature (1)..(1683): Codon Optimized Sequence Encoding H10 Hemagglutinin
atgtacaagatagtggtcattattgctctgttgggagctgtgaaagggcttgataagatttgcctgggccaccacgcggtggcgaatgggacgatcgtgaaaactctcacaaacgagcaggaagaagtgactaacgctacagagaccgtggaaagcacggggatcaataggctgtgcatgaagggccggaagcataaggatctaggcaactgccacccaattggcatgctcatcgggacgcccgcatgcgatctgcacctgacagggatgtgggacacccttatcgagcgtgagaacgccatcgcctattgctaccccggggcaacagtgaatgtggaagcactgaggcagaagatcatggagagcgggggaatcaacaagatatccacaggcttcacatatggatcatcaatcaacagcgccggcaccacccgggcatgtatgcggaacgggggcaatagtttctacgctgagctcaaatggcttgttagtaagtctaaggggcagaactttccacagactacgaatacgtaccgcaatacggatactgcagaacacttaataatgtggggaatccaccacccaagttccacccaggagaaaaacgatttgtacggaacccaatccctgtcaatatccgtgggaagctctacctataggaacaatttcgtcccggtcgtgggagctcggccacaggtgaacggacagagtggaaggatcgacttccactggacgctcgtgcaaccaggtgataatatcacgttcagtcacaacggcggactgattgctccaagccgcgtcagcaagctgataggccgggggctggggatccagtcagacgcccctattgacaataattgtgagtccaaatgtttctggagaggtggctctatcaatacccgccttccctttcagaacttgtccccacggacagtgggacagtgccccaagtatgtcaatcgcaggtcactgatgctggcaaccgggatgaggaacgttcccgaactcattcaaggccggggtctatttggcgcaatcgccggcttcctggaaaatggctgggaaggaatggtggacgggtggtatggtttccggcaccagaatgctcagggcacaggccaggctgctgattataagtctactcaggcagccattgaccagatcaccggtaagctcaatagattggtagaaaaaacaaacacggagttcgagagcatcgagtctgaattttccgagatcgaacatcagatcgggaacgtcatcaattggaccaaggactctattacggacatttggacttaccaagctgagctcctggtggcaatggagaaccagcataccattgatatggccgactctgagatgctgaacttatacgaacgggtgcgaaagcaactgaggcagaacgccgaggaggatggtaagggctgctttgagatatatcatgcctgtgatgattcttgcatggagagcatccgtaataatacttacgaccatagccagtatcgagaggaagcgctactcaatcgattaaatatcaaccctgtgaccctatcttcgggttacaaggacataattctgtggttctcattcggcgcatcttgtttcgtattgctcgcagtggtgatgggcctttttttcttctgtctgaaaaatggtaacatgcgctgtactatatgcatt

SEQ ID NO: 729 - DNA, 1683 bp, Influenza A virus
  misc_feature (1)..(1683): Codon Optimized Sequence Encoding H10 Hemagglutinin
atgtacaaaatagtggtgattatcgccctcctgggtgctgtcaagggcctggataagatctgtcttggccatcacgctgtcgcaaatggcactatagtcaaaactctgacaaacgagcaggaggaggtgaccaacgcaaccgagacggtggaatctactggaattaacaggctgtgtatgaagggtaggaagcataaggatctaggtaattgccatcccatcggtatgctgatcggaactcccgcgtgcgacttacatctcactggaatgtgggacacgttgatcgagcgggagaatgctattgcgtactgctaccccggcgctacggtgaacgtcgaggctttgcgtcagaagatcatggagagcgggggtatcaacaaaataagtaccggattcacatacggaagcagtatcaattccgccggaacaacccgcgcatgcatgcggaacggtggtaattccttctatgctgaactcaagtggctcgtgtcaaagagcaagggacaaaactttccccaaacgaccaatacctatagaaatacagacactgctgagcatctgatcatgtggggcattcaccatccatcatctactcaggaaaaaaacgacctgtacggtacccagagcctgtctattagcgtcggatcatcgacctacaggaataacttcgtgccagtcgttggggcccgccctcaggtgaacggccagagcggacggattgattttcactggaccctggtccagccaggtgataacatcaccttctcacataacggaggcctgatcgcccccagccgagttagtaaactaatcggaaggggacttggtatccagagtgacgcacccatcgacaacaactgtgagtctaagtgtttttggcgaggcgggagtatcaatactagactgccgtttcagaatttgagtcccagaacagtgggccagtgccctaagtacgtgaaccggaggtctctgatgctcgcaaccgggatgcggaatgttcccgagctgatccagggacgcggtctcttcggtgccatcgctgggtttctcgaaaacggctgggagggaatggtggatggttggtacggcttcagacatcaaaacgctcaaggaactggccaggccgctgactataagtcaactcaggctgcaatcgatcagatcaccgggaaactgaatcgcctcgtggagaagacaaacaccgagttcgagtcaatcgagtccgagttctccgagatcgaacaccaaataggcaacgttataaactggacgaaggactccattacggacatctggacataccaggccgagctcctcgttgctatggagaaccaacacacaatcgatatggctgattccgagatgctcaatctctacgagagggtgaggaaacagttgaggcagaatgcagaagaggatggaaagggatgctttgaaatctaccatgcctgcgacgactcatgcatggagtccattagaaataacacttatgaccattcgcaatacagagaagaagctcttctcaacaggctcaacatcaacccggtcacccttagctccggctacaaggacattatcctctggttctctttcggggcatcatgctttgttctcctggcagtggtgatgggtctcttcttcttctgtctcaaaaacggcaacatgagatgtacgatttgtatc

SEQ ID NO: 730 - DNA, 1683 bp, Influenza A virus
  misc_feature (1)..(1683): Codon Optimized Sequence Encoding H10 Hemagglutinin
atgtataagatcgtggtgatcatagcgctcctgggcgccgtgaaaggactggataaaatttgtctggggcatcatgcagtcgccaacggaaccatcgtaaagactttgactaatgagcaggaaaaggttaccaatgcaaccgaaaccgtggagagcaccggtctgaaccgcctctgcatgaagggccgtaaacacaaagatctgggcaattgtcatcccatcggaatgctaatcggcactcctgcctgtgacctacacttgaccgggacttgggataccattatagagagagagaatgctattgcctactgttaccccggggcaaccgtgaacgaagaagctttgagacagaaaattatggagagtggcggaatagataagattagcacagggttcacctacggaagctctattaatagtgcgggcaccacaagggcatgcatgcggaacggcggtaactctttctatgctgagttgaagtggctcgtgagcaagtctaaagggcagaactttccacaaaccaccaacacttacagaaacacggatactgccgagcacctcatcatgtggggcatccaccatccttcatcaacacaagagaagaacgacttatatggtactcagagtctgtcgattagcgtcggctcttcaacgtacaggaacaatttcgttcctgtagtcggggcccggccacaagtaaatggacagagcgggaggattgatttccattggacgctggtccagcccggagataacataactttctctcataacggaggactcatagctccatcaagggtgagcaaactgattggcaggggattgggaatccagtctgacgctcccatcgacaacaattgtgagagtaagtgcttttggcggggcggttccatcaacacacgactgcctttccagaatctgagtcccagaactgtggggcagtgcccaaagtatgtgaataaaagatctttgatgttagctactggaatgagaaatgtgcctgagctaatacagggtagaggtctgttcggagcaatagcagggttcctggagaatgggtgggaaggcatggtcgacggatggtacggtttccggcatcagaacgcacaaggtacagggcaggcggctgattacaaatctacacaagccgctattgaccaaatcaccggcaaattgaaccggctcgtggagaagacgaatacggagtttgaatctattgagagtgagttcagtgagattgaacatcagattggcaacgttataaattggaccaaggacagcataactgatatatggacctatcaagccgagcttctcgtggccatggaaaatcagcatactatcgacatggctgactctgagatgctcaacttatacgaacgtgtaaggaagcagctgcggcaaaacgccgaggaagacggtaagggctgcttcgagatttatcacgcgtgcgatgactcttgtatggagtccatcagaaacaacacctacgatcactcacagtatagagaagaggctttgttgaatcggctcaacatcaatccagttaccctttcaagtggttacaaggacatcatcctatggtttagcttcggtgcctcttgtttcgtgttgctggcggtcgttatggggttggtctttttttgcttgaaaaatggtaatatgcggtgtaccatttgcatc

SEQ ID NO: 731 - DNA, 1683 bp, Influenza A virus
  misc_feature (1)..(1683): Codon Optimized Sequence Encoding H10 Hemagglutinin
atgtacaagattgtggtgatcatcgcgctgcttggtgctgtgaagggactcgacaaaatatgcctggggcatcatgctgtcgccaatgggacaattgtgaagacattgacgaacgagcaggaggaagtcactaacgcaacagagacagttgagagcaccgggattaaccgactgtgtatgaagggtcggaagcacaaggacttgggtaactgtcacccgatcggcatgttaatcggaacccctgcctgtgacctgcatctgaccggcatgtgggacacactgatagaaagggaaaacgccattgcatactgctaccccggggctacggtaaatgtggaggctctccggcagaagataatggagtcaggcggcatcaacaagatctctaccgggttcacgtacggctcttctatcaattcagctggaactacccgcgcatgcatgagaaacggtgggaactccttttacgccgaactgaaatggctagtgtccaaatctaagggccagaatttcccacagaccactaatacttacagaaacacggatacagccgaacacttgataatgtgggggattcatcacccatcatctacacaggaaaaaaatgatttgtacggtacccagagccttagcatttctgtgggcagctctacctacagaaataacttcgtgccagtagtaggtgctcgaccgcaggttaatggccaaagcggtagaatcgattttcactggacattggtgcagccgggcgacaacataaccttttcccataatgggggacttattgcaccttccagggtgtccaaactcataggccgcggcctcggcattcaaagcgatgctcccattgacaataattgtgaatcaaagtgcttctggcgtggaggaagtataaacacacggctgcccttccagaacttaagcccaagaaccgtggggcagtgccctaagtacgttaataggcggtcgcttatgcttgcaacaggtatgaggaacgtcccggagcttatccaaggcaggggacttttcggagctatcgccggttttttagagaacggatgggaaggaatggtggacggttggtatggattccggcaccaaaatgctcagggcaccgggcaggcggctgactacaaatctacacaggcggctatcgatcagattacgggaaagctgaataggttagtggaaaaaacaaacacagagtttgagagcatcgaaagcgagttttctgagatagagcatcagatcggtaatgtaatcaactggaccaaagacagcatcacagacatatggacgtaccaggctgagcttctagtcgccatggaaaaccagcacactattgatatggcagattctgagatgcttaatctgtatgaacgagtgcgaaaacagctgcgccagaacgccgaagaggatgggaagggctgtttcgaaatctaccacgcctgcgacgactcctgcatggaaagcattagaaataatacctacgatcattcgcaatatcgggaagaggccctcctgaatcgcctaaatatcaatcctgttacactaagcagcggctacaaagacattattttatggttctccttcggcgcctcctgcttcgtactattagccgtagttatgggtctgttcttcttttgccttaagaacggtaacatgagatgcacaatctgtata

SEQ ID NO: 732 - DNA, 1683 bp, Influenza A virus
  misc_feature (1)..(1683): Codon Optimized Sequence Encoding H10 Hemagglutinin
atgtacaaaattgttgtgatcattgccctcctgggggcagtgaagggactggacaaaatctgcctgggtcaccacgccgtggcgaacggcaccattgtgaagaccctgaccaatgaacaggaagaggtgaccaatgctaccgagactgtagagagtacaggcatcaataggttatgcatgaaaggccgcaaacacaaggacttgggaaactgccaccctataggcatgttgatcgggacgccagcttgcgacttgcaccttacaggaatgtgggataccttgatagaaagggaaaacgctatcgcttactgctacccgggcgctaccgtcaatgtggaagcactgcgacagaaaattatggagagtggtggcataaataaaatatcaactgggttcacatacggaagctcaatcaatagcgcgggcacaacacgagcctgcatgcgtaacggaggaaacagcttttatgcagagctcaaatggttagtttcaaaatctaaggggcagaactttcctcaaaccactaacacgtatcggaataccgacacagcagagcacttaataatgtggggcatacatcatccctcaagcacacaggaaaagaacgacctgtacggaacgcagtccttatcaatctctgtggggtccagcacataccgaaacaactttgtaccagtcgtgggtgctcgcccacaagtgaacggccagtctgggcgcatcgactttcactggactttggttcagcctggtgataatatcacctttagccataatggcggactcatagcgccaagcagggtgtccaaacttatcggacgtgggttgggtattcagagcgacgcaccaatcgacaataactgcgagtcaaagtgtttttggagaggcgggtcaatcaacacccgcctgcccttccagaacctgtctccccgtacggtggggcagtgtccaaagtacgtgaataggcggagcctgatgctggccacagggatgcgcaacgtgcctgagctcattcaaggccggggcttgtttggagccatcgcgggttttctcgaaaacgggtgggaagggatggtcgatggctggtacggctttcggcaccagaatgctcagggaacggggcaggctgccgactacaagtcaacgcaggcggccatcgatcaaatcaccggcaagctcaacaggctcgtggaaaaaaccaatacggagttcgaaagtatcgaaagcgagttcagcgaaattgagcaccagatcggcaatgtaatcaattggactaaggatagcatcaccgatatctggacataccaagctgagctgttagtcgccatggagaatcagcatacaatagacatggctgatagtgaaatgttgaatctgtacgagagggttaggaaacagctgcgccagaatgctgaggaagacggaaagggctgctttgaaatctatcacgcttgcgacgattcctgtatggagtccatacgaaataatacgtacgaccattcccagtaccgcgaagaggctctcctgaatcggctgaacatcaaccctgtgacacttagctcgggctataaggacataattttgtggttctcttttggggcatcatgttttgtcttgctggccgtcgttatggggctcttcttcttctgtctaaaaaatggaaacatgcggtgcaccatttgtatt

SEQ ID NO: 733 - DNA, 1683 bp, Influenza A virus
  misc_feature (1)..(1683): Codon Optimized Sequence Encoding H10 Hemagglutinin
atgtataaaatcgtggtgatcattgctctgttaggcgccgtgaagggcctggacaagatttgcctaggacatcatgccgtcgctaacggcactatcgtgaagactctgaccaatgagaaagaggaggtgactaacgcaacagaaacagttgagtcaactggcctgaaccggctctgcatgaaagggagaaagcataaagacctaggcaattgccatcctattggtatgctcattggctctcccgcctgtgacctgcatcttactggaacgtgggacaccctgattgaaagagaaaacgccatcgcgtattgctacccgggggccaccgtgaacggagaagcgttacgccaaaagatcatggagtcaggcggcatcgataagatcagcactggctttacctacgaaagtagcatcaacagcgctggaaccacccgcgcctgtatgagaaacgggggtaattccttctatgcggagctgaaatggcttgtgtctaaatccaaaggccagaactttccacagacaacgaacacttatcggaatactgacacagcagagcatcttatcatgtgggggatccaccatcctagttccacgcaggagaagaatgacctgtatgggacacaaagcctgtctattagcgtgggatcatcaacttacaggaacaattttgtccctgtggtgggcgccaggccccaggtaaacggacagagtggacgcatcgactttcattggactctcgtgcagcctggggataatattaccttcagccataatggtggcctgatagcaccctcaagagtgtcaaaactcatcggtcgcggattggggattcaatctgacgcccctatagataacaattgcgagagcaagtgcttttggagaggaggcagcatcaacacccgccttccctttcagaatctgagtccccggacggttgggcagtgtcctaaatatgtcaataagcggtcactcatgttggcaactggcatgcgcaacgtacctgagctcatgcagggaaggggcctctttggagctattgcagggttcctggagaacggctgggaggggatggtagacggatggtacggattccggcatcaaaatgcgcaaggcactggtcaagctgctgattataagtccacccaggccgctattgatcagattaccggaaagctgaaccggctggtggaaaagaccaatacagaatttgagagcattgaatcggagtttagcgaaatcgaacatcaaattgggaacgtcataaactggacaaaagacagcatcaccgatatctggacataccaggcggagctgctagtggcgatggagaatcagcacacgattgatatggccgactctgagatgctgaatctgtatgagcgggttagaaagcagctgaggcaaaacgcagaagaagatggtaaaggatgctttgagatctatcatgcctgcgatgactcatgtatggaatctatccgtaacaatacatacgatcacagtcagtatcgggaggaagctctgctgaataggctaaacatcaatcccgtgaccctctcgagtggctataaggatatcatcttgtggttctctttcggcgccagctgtttcgtgctactggccgtcgtgatggggctggtattcttctgcctgaagaacggtaatatgcgctgcaccatatgtatt

SEQ ID NO: 734 - DNA, 1683 bp, Influenza A virus
  misc_feature (1)..(1683): Codon Optimized Sequence Encoding H10 Hemagglutinin
atgtacaagatcgtggtcatcattgcactgcttggcgctgtgaaaggattagacaagatttgcctcggccaccacgccgtcgccaatgggaccatcgttaagacattaacaaatgaacaagaagaggtaaccaacgccaccgagaccgtggagtcgacaggcatcaaccggttatgcatgaaagggcggaaacacaaagatctggggaactgccatccaatcggaatgctcattggcaccccagcgtgcgatctccatctcactggcatgtgggatacattaattgagagggagaatgcaatcgcatattgctaccctggcgccactgtcaacgtcgaggccctgcgccagaaaataatggaatcaggtggcataaacaagatttccaccggatttacttatggctcttccatcaacagcgctggcaccacacgggcttgtatgcgaaacgggggcaactcattttatgcagaactgaagtggcttgtctcaaaaagtaagggtcagaactttccacagacaacaaatacatacaggaataccgacactgcagagcatctgatcatgtggggcatccaccatcctagttcgacacaggagaagaacgacctgtatggcacccaatcactgagtatctctgtggggagtagtacttatcggaacaattttgtgccagtcgtgggcgcaagaccacaagtcaatggccagagtggccgtatcgacttccattggaccctggtacagcctggtgataacatcacctttagccacaacggaggactgattgcaccgtcaagagtttcaaaactgatcggccgaggcctgggaatccagagcgacgctcccatcgataataattgtgaaagtaagtgcttctggcggggtggatccatcaacacccgtctaccctttcagaatctgtcaccccggaccgtcggacagtgcccaaaatacgtgaacaggcgcagtttgatgttagctacagggatgagaaacgtgccagaactgattcagggacgcggactgttcggcgccatcgccggcttcctcgaaaacggttgggagggtatggtggacggttggtatggcttcaggcatcagaacgcccaggggacaggccaggccgctgactataagagcactcaggcggctatcgaccagatcactgggaagctcaatcgtctcgtcgagaaaacgaataccgagtttgagagcatcgaaagtgaattctctgagatagagcaccagatcggtaatgtgatcaattggacaaaggactcgattactgacatctggacgtaccaagccgagctgctcgtcgccatggaaaatcagcataccattgatatggctgactcagagatgcttaacttgtacgaacgggtccggaaacaactgagacagaatgccgaagaggacgggaaaggctgttttgaaatctatcacgcctgtgatgattcttgtatggaaagcattagaaacaatacatacgaccattcacagtacagggaggaggctttactcaatcgcctgaacatcaatcccgtaacattgagctctggatataaagacattatcctctggttctcctttggtgcctcttgttttgtactcctggcagtggttatgggtctcttcttcttttgtctaaagaacggtaatatgaggtgtaccatttgcata

SEQ ID NO: 735 - DNA, 1683 bp, Influenza A virus
  misc_feature (1)..(1683): Codon Optimized Sequence Encoding H10 Hemagglutinin
atgtacaagatcgtggtgattattgccctgttgggggccgtgaagggcttggacaagatatgccttggtcaccatgctgtggccaacggcactatcgtcaaaacactgacaaacgagcaggaagaggtgaccaacgccacggagactgtagaaagcaccgggattaaccgactatgtatgaaaggccgcaaacacaaggacctcgggaactgccatcccatcggcatgttaataggcacccccgcttgcgatctgcacctgacagggatgtgggataccctaattgagcgcgagaacgcaattgcctattgttacccaggagccacagtaaatgtagaagctttaaggcagaagattatggagagtggagggattaacaagatcagcacgggcttcacatacggttcctccatcaattctgctggaaccaccagggcatgcatgcgtaatgggggaaactcattctacgcagagctaaagtggctggtttccaagtctaagggacagaacttcccgcagacaacgaatacttatcggaacaccgacactgccgaacatttaatcatgtgggggatccaccaccccagttctacccaggagaaaaatgatctctacggtactcagtccctgtccatctccgttggttcctccacctatcggaataattttgtccctgttgtgggagcacggccacaggtgaatggccagtccgggaggatagactttcactggacccttgttcagcccggggacaatatcactttctcacataatgggggcctgattgctccttccagagtgagtaaattgataggccgggggctgggcatccaatcagatgcacccattgataacaactgcgagtccaaatgcttctggcgcggaggcagcatcaatacccgactgcccttccagaacctgtctcctaggacagttggccagtgtcccaaatatgtaaaccgcagatcactgatgctggctaccggtatgagaaacgtcccagagctaattcaaggccgaggactttttggcgctattgcaggattccttgagaacgggtgggagggcatggtcgacggctggtacgggttcagacaccaaaacgctcagggaacaggccaagccgcggactataaatcaacacaagcggccattgatcagataaccggcaagctgaataggctggtggaaaagactaacactgagtttgaaagcatcgagtcggaattctctgagattgaacaccagattggaaatgtaatcaactggacaaaggattccatcaccgacatctggacttatcaagcagaactgttagtggccatggaaaatcagcataccatcgacatggccgacagcgagatgctgaatctgtacgaacgggttcgtaaacagctgaggcagaacgcagaggaggacggtaagggatgctttgaaatttatcacgcttgtgacgatagttgtatggagagcattaggaacaacacttacgaccactctcagtatagggaagaagcactccttaacaggctgaacatcaaccctgtgacgctctcttccgggtataaagacatcatcctgtggttttcatttggcgcttcatgttttgtactgctagcagtggtgatgggtctcttctttttttgcctcaaaaacgggaacatgaggtgcactatttgcatc

SEQ ID NO: 736 - DNA, 1683 bp, Influenza A virus
  misc_feature (1)..(1683): Codon Optimized Sequence Encoding H10 Hemagglutinin
atgtacaagatcgtagtgataatcgctctactaggagctgtcaaaggtctcgataagatatgtctggggcaccatgcggtagccaatggaacgatcgtgaaaacacttactaacgagcaggaggaggtcaccaacgccacagaaacggtggaatctacggggatcaaccgcttatgcatgaaggggaggaagcataaggatttgggcaattgccacccgattggaatgctgattgggactcctgcttgcgatctgcacttaaccggcatgtgggatacgctaatagagcgcgaaaacgccatcgcctactgttatcccggcgcgacagtaaacgtagaggcactaagacagaagattatggagtccgggggaataaacaagataagcacgggctttacctatggatcatccatcaattctgctggaacaacacgcgcctgcatgcggaacggaggcaattctttctatgcagagctgaaatggctcgtgtccaaaagtaaaggtcagaacttcccgcagactacaaacacttataggaacactgacacagctgagcatctaatcatgtggggtattcaccacccaagttcaacccaagaaaaaaatgatctctacggcacgcagtcactttccatctctgtgggctctagcacctacagaaacaactttgtcccagtggtgggagctcggcctcaagtgaacggacagtccggtaggatcgattttcattggaccctcgtacagcccggggataacatcacttttagtcacaatggtggcctgattgccccctccagggtgtctaagttgattgggcgcggcctaggtatacagagtgacgcccccatagataataattgcgagagcaaatgtttctggaggggcggaagtatcaatactcggctgccttttcagaaccttagcccacgtactgtgggccagtgtcccaagtacgttaatcgaagaagcctgatgcttgcaaccggaatgaggaacgtgcccgaactgatccaaggtcgtggcttattcggagccatcgccggattcctggagaacggatgggaagggatggtggatgggtggtacgggttccgacaccagaacgcccagggaacaggtcaagccgccgattacaaatcaacacaagcggccatcgatcagattactggaaaactgaacaggttggtggagaagactaacacagagttcgagtcaatcgaaagcgaatttagcgagattgagcaccaaatcgggaacgtgatcaactggacaaaggattccattaccgacatatggacctaccaggctgagctgttggtggcaatggaaaatcagcatactatcgatatggccgattctgagatgctgaatctgtacgagcgggtcagaaagcagctgagacaaaatgctgaggaagacggtaagggttgtttcgagatctaccatgcctgcgacgactcttgcatggagagcatcaggaacaacacatacgatcactcccagtatagagaagaagctctgttgaataggcttaacatcaacccagtgacgcttagtagcggttacaaagatatcattctgtggtttagttttggggcctcatgtttcgtgcttttggcagtagttatggggctgtttttcttctgtctcaaaaatggtaatatgcgatgcacgatttgtatt

SEQ ID NO: 737 - DNA, 1683 bp, Influenza A virus
  misc_feature (1)..(1683): Codon Optimized Sequence Encoding H10 Hemagglutinin
atgtacaaaatcgtggtcattatcgccctgctgggcgcggtgaaaggcttggataaaatctgcctcgggcatcacgccgtggtgaatggaacgatcgtgaagactctgaccaacgaacaggaagaggttaccaacgcaacggaaacagtcgaatcaaccggactcaatcgtttatgtatgaagggcagaaatcacaaggaccttggaaactgccacccaatagggatgcttataggaaccccagcttgcgacctgcacctaaccggcacctgggacactcttattgagagagagaacgcaattgcttactgttaccccggcgcaacagtgaacgaagaggccctcaggcagaagattatggagtctggagggataaacaagatatcgaccggtttcacctatggatcctctatcaattctgcagggacaacccgcgcctgtatgagaaatggcggaaactccttttatgccgaactgaagtggcttgtttccaaaagcaaaggtcagaactttcctcaaacaactaatacgtacaggaacaccgataccgccgagcacctgatcatgtggggaatccatcaccctagcagtacccaagaaaaaaacgacctatatggtacccagtccctcagcatctcagtgggctcatcaacctatcaaaacaacttcgtgcctgttgtcggcgcacgaccccaggtgaacggtcaaagcggaaggatcgatttccattggaccctggttcagcccggcgacaatatcacatttagtcacaatggcggtctgattgcaccttcccgcgtgagtaaactgatcggtcgggggcttggaattcaaagcgacgcccccatcgacaacaattgtgagagcaagtgtttttggagaggcgggtcaataaacaccaggctgccctttcagaacctaagtcccaggactgtaggccagtgtcccaaatacgtcaataagcgttcactaatgttggccacgggaatgagaaacgtgcccgagctgatgcaaggcagaggcctgttcggggccatcgcggggttcatcgagaacggttgggaaggcatggttgatggttggtatggatttaggcaccagaacgctcagggcacaggacaggccgctgactataagagtactcaagccgcaattgaccagatcaccgggaagttgaaccgactcatcgagaagacgaacacagaattcgagagcatagagtcagagttctcggagatcgaacaccaaattggcaacgttatcaattggactaaggactcgatcactgacatctggacataccaggctgagctgttggtggccatggaaaaccagcacaccatagacatggccgacagcgagatgctgaatctctacgaaagagttcgcaaacagctcaggcagaatgccgaagaagacggtaaaggatgctttgaaatctatcacgcttgtgacgattcctgcatggagagcatcagaaacaatacctacgatcacagccagtaccgggaagaagcactcctgaataggctgaacataaatccagtaactctttcgtccggatacaaagacataatactctggttttcgtttggtgcatcctgcttcgtgctgctcgcagtggtgatggggcttgtctttttctgtttgaagaacggaaatatgcggtgcaccatatgcatc

SEQ ID NO: 738 - DNA, 1683 bp, Influenza A virus
  misc_feature (1)..(1683): Codon Optimized Sequence Encoding H10 Hemagglutinin
atgtacaagatcgttgtgataattgccttgctgggcgcagtcaaaggactcgataagatctgtctcggccatcacgccgttgccaatggaaccattgtgaagactctcactaacgagaaagaggaggttacaaacgctaccgaaactgtggagagtactggtctgaaccgactgtgtatgaagggcagaaagcataaggatctgggtaattgtcaccccatcggaatgttaatcggtagcccagcctgtgatttgcaccttacagggacctgggatacactcatagagagggaaaacgccatcgcatattgttatcccggggccacggtgaacggagaagctttacgccagaagatcatggagtccggggggatcgataagatcagcaccggattcacctacgagagtagtataaactcagcgggcaccaccagagcgtgcatgcggaatggcggcaatagcttttatgctgagcttaagtggttggtgtccaaatctaagggacagaatttcccccagaccaccaatacgtaccgcaatacagacacagccgagcatttaatcatgtggggaatccaccacccatcgtctacccaggaaaagaacgacttgtatgggactcagagtctttccatctccgtcggatcctcaacctaccggaacaatttcgtgcccgtggtaggggcgcgtccccaagttaacggccaatctggcaggatagatttccattggactctggtgcagcctggcgacaacattaccttctcgcataacgggggactgatcgccccctctcgcgtttctaagctgatcggccgcggtctgggcatccagtctgacgctcccattgacaataactgcgaatcaaagtgcttttggagaggagggtctattaatactaggttgccctttcagaatctgtccccccgaaccgtcgggcagtgtccgaaatatgtcaacaaacgctcattaatgcttgctactggcatgaggaatgtccctgagttgatgcagggcagggggctgttcggcgccatagcagggtttctcgagaacgggtgggagggcatggtagatgggtggtacggctttaggcatcagaatgctcaaggtaccggccaagccgccgactacaaatccacacaggccgcaattgaccagatcacaggtaaattgaatcggcttgtggagaagaccaatactgaattcgaaagtattgaatccgaattttctgagatagagcaccaaatcggtaacgtgatcaactggactaaagattctatcaccgacatttggacatatcaggcggaattgctggtggctatggagaaccagcacacgattgatatggctgacagcgagatgctgaacctttacgagcgagtgcgtaagcaactgaggcagaacgcagaggaggatggtaaggggtgcttcgagatatatcacgcatgtgatgattcatgcatggagtccattcgcaacaatacatacgatcacagccagtatcgggaggaagctctgctaaaccgattgaacattaatccggtaactttgtcctccggttacaaggacattatcctctggttctcgttcggggcaagttgcttcgttcttttggcagtcgttatgggtctggtttttttttgcctgaagaacggcaatatgcgctgcacaatctgcatc

SEQ ID NO: 739 - DNA, 1683 bp, Influenza A virus
  misc_feature (1)..(1683): Codon Optimized Sequence Encoding H10 Hemagglutinin
atgtataagattatagtaatcatagctcttctaggcgctgtcaaaggactagacaagatctgtttaggccatcatgctgttgcaaatggaacaatcgtgaaaacattaacaaacgaacaggaagaggtaacaaatgctactgagacagtcgaaagcactggcatcaacaggctgtgcatgaaggggcgtaaacacaaggaccttggcaactgccatcccatcggaatgctcatcggcacccccgcatgcgatctgcacctaaccggaacctgggacactctcatcgagcgcgaaaacgcaatcgcctactgctaccccggcgctacggtgaacgtcgaggcgttgcgacagaagattatggaatcaggtggaatcgataagatctccactggatttacatacggatcgtctatcaacagcgccggtacaactcgcgcctgtatgcgtaacggcggaaactcattttacgccgaattaaagtggctggtgagcaaaagtaaagggcagaactttccgcaaacaacaaatacctatagaaatacagacactgccgagcacctcattatgtggggtatacaccaccctagcagcacgcaggagaaaaacgacctctacggaacccagtcactgagcatctcagttggttcctccacataccggaacaatttcgtgcccgtcgtgggcgcacgccctcaggtcaatggacagtctggtcgtatagactttcattggacgcttgtgcagccaggcgataacatcacatttagccataacggggggttgattgctccctcacgggtgagcaagctaataggtaggggcctcggtatccagtccgatgcacctattgataacaactgcgagtctaaatgtttttggcgaggtgggtccatcaatacgcggctgccttttcagaatctttctcctcgaactgtcgggcaatgcccaaaatacgtcaaccgtcgtagtcttatgttggctacagggatgcggaacgtaccggaacttattcagggcagaggcctgtttggtgcgatagccggcttcctggaaaacggatgggagggaatggtcgatggatggtacggttttcgacatcaaaatgcccagggaaccgggcaggcagcggactataagtctacccaggcagccatagaccagattacaggaaagctcaatagactcgtggagaaaactaacacagagtttgaatcaatcgagagcgagttcagcgagattgaacatcaaatcgggaacgtgatcaactggaccaaagattctatcacagacatttggacataccaagctgaactcctagttgccatggaaaatcaacacactatcgatatggccgattcagaaatgttgaatctgtatgagcgcgtgagaaaacaactccgccaaaacgcagaagaggatggcaagggctgttttgagatctaccacgcctgtgatgactcttgtatggagtccattcggaataatacctacgatcatagccagtatcgggaagaggctctgcttaaccgattgaacattaatcccgtgaccttgtcaagcggttacaaagacataattctatggttctcatttggcgcctcctgctttgtgctgctcgctgttgtcatgggcctcttttttttttgtctgaaaaatggaaatatgcgatgtaccatctgcatt

SEQ ID NO: 740 - DNA, 1683 bp, Influenza A virus
  misc_feature (1)..(1683): Codon Optimized Sequence Encoding H10 Hemagglutinin
atgtataaaattgtcgtgatcatagctctccttggggctgtgaaaggcctggataagatctgtctgggacaccacgcggtggcaaatggcactatcgtcaaaaccctgacaaacgagcaggaggaggttactaacgccacggaaacggttgagtccaccgggattaacagactttgcatgaagggcaggaaacacaaggatctcggtaactgtcaccccattggcatgctgattgggactcccgcatgtgaccttcacttaaccggaatgtgggacactctgatcgagcgtgaaaacgccattgcctactgttatcccggggcaacagtgaacgtcgaggcgttgaggcaaaagatcatggaaagcggcggcatcaacaaaatcagcactgggttcacatacggatctagcattaacagcgccggcactacacgtgcatgtatgaggaatggcggcaattctttttacgccgaactgaagtggcttgtttccaaatccaagggtcagaactttccacaaaccacgaatacctatcggaatactgacactgcagagcatctaattatgtggggcatccaccaccccagttcaactcaggagaagaatgacttgtacgggacccagagcctgagtatttctgttgggagttcaacctacagaaataacttcgtccctgtcgtcggggctagacctcaagttaatggtcagtccggccgtatcgactttcactggactctggtacagccgggggataacattacattctcacacaatgggggtctcatcgcacccagccgggtgtccaaactcattggccgaggattggggatccaatccgatgcccccatagacaacaattgcgagtctaaatgcttttggaggggcggctctataaacacacgcctgccattccagaacctcagtccccggaccgtcgggcagtgcccaaaatatgtgaatcgaaggagtcttatgctggctactggcatgcgtaacgtgcctgagctgatacagggaaggggccttttcggggctatcgccggatttttagagaatggatgggaggggatggttgacgggtggtatggatttcggcaccagaatgcacagggtacaggacaagccgccgattacaagtctacccaagctgcaatagatcagatcaccggcaaactcaaccggcttgttgaaaagaccaacacagaattcgaatcaatcgagagcgagttctctgaaatagagcatcagattggcaacgtgatcaactggacaaaagactctattacagacatctggacttaccaggctgagttgctcgtggccatggagaaccaacatacaatcgatatggcagactcagagatgcttaacctgtatgaacgtgtgaggaagcagctccgccagaatgctgaagaggacggaaaggggtgttttgagatataccatgcctgcgacgatagctgcatggagtccatcaggaacaatacgtacgatcactcccaatacagagaggaggccttgctgaatcggcttaatatcaaccccgtcacgctgagttccggatacaaggatattatactatggttctcatttggcgcttcatgcttcgtgctcctcgccgtggtgatgggcctgtttttcttttgcctgaagaacggtaacatgaggtgtacaatctgcatt

SEQ ID NO: 741 - DNA, 1683 bp, Influenza A virus
  misc_feature (1)..(1683): Codon Optimized Sequence Encoding H10 Hemagglutinin
atgtacaaaatcgtggtcattattgccctgctgggcgccgtaaaaggcctcgataagatttgtctgggacatcacgcggtggctaacggaacaattgttaaaaccctgactaacgagcaggaagaagtcacaaacgctacggagaccgtggagagtaccggaatcaatcgcctgtgcatgaagggccgtaagcacaaggacctgggtaactgccatccaatcgggatgcttatcggcacgcctgcttgcgatttgcatctgactgggatgtgggacactctgatcgagcgtgagaacgctatagcttactgctaccccggagccaccgtcaatgttgaagcactgcgtcagaagatcatggaaagcggtggcatcaacaagatctctaccggattcacttatggctcttccataaactcagcaggcaccacacgggcatgcatgcggaatggcggcaactctttctacgccgaactaaaatggctggtgagtaagagcaaggggcaaaactttccacagaccactaatacatacaggaatactgacaccgcagagcacctcatcatgtggggaatccaccatccttcaagtacccaagagaaaaacgatctctacgggacacagtcacttagtatatccgttggctcaagcacttacagaaataattttgtgcccgtggtcggcgcccgcccccaggttaatggacagagcggacggattgactttcattggaccctggtccagcccggagacaacataacttttagccacaatggcgggttgatcgcacccagcagagtttccaagctgataggaagagggctgggtatccaatccgatgcccccatcgataacaattgtgagtcaaaatgcttctggcgcggagggtcaatcaacacacgccttccctttcaaaacctctcacctcggaccgtgggtcagtgtccgaaatatgttaatcgacggagcctgatgctggccaccgggatgcgcaacgtgcccgagttgatccagggtaggggcttatttggtgcaatcgccgggttcctggagaacggatgggaaggcatggtagacggctggtatggattccgccatcagaacgcccaggggacaggccaggcagccgattataaaagcacccaggctgcaatcgaccagatcacgggaaagctgaaccggctggtggagaagactaatacggaattcgaatctattgagtctgaattcagtgagattgagcatcagatcggcaacgtgattaattggactaaggatagcatcaccgacatttggacctatcaggccgagctgctggtggctatggaaaatcagcatacaatcgacatggctgactctgagatgctgaacctctacgagagagtcagaaaacagttacgtcagaacgccgaggaggatggcaaggggtgctttgagatctatcacgcgtgcgacgatagttgcatggagtcaattaggaacaatacctatgaccatagtcaataccgggaggaggccctgttgaaccggctgaacatcaaccctgtgacactgtcctcggggtataaggacatcatcctttggttctcatttggagctagctgcttcgtgttattggccgttgtgatgggccttttcttcttctgtctcaaaaatggaaacatgcgctgtaccatttgtatt

SEQ ID NO: 742 - DNA, 1683 bp, Influenza A virus
  misc_feature (1)..(1683): Codon Optimized Sequence Encoding H10 Hemagglutinin
atgtacaaaatcgtgctcgttctggctcttcttggggctgtgcacgggctggataaaatttgcctgggccaccatgccgtcccaaatggcactattgttaagactttaaccaacgagaaagaggaagtgactaatgctaccgagacagtggaaagcaaaagcctggacaagctttgtatgaaaaataggaattacaaggatctgggcaattgtcatccaattggcatggtcgtcggcactcccgcctgcgatctgcaccttacaggcacgtgggataccctcatcgagcgcgataacagcattgcatattgttacccaggggccacggttagtgaggaagcattgagacagaagatcatggagagtggtggcatcgataagatttcaacagggttcacctatggatcttctatcaatagtgcaggtaccactaaggcttgcatgcgcaacggcggcaactcattttactctgagttgaagtggctcgtcagtaaaaataagggccagaactttccgcagacaacaaatacttaccgaaacacggatagtgtggaacacctcataatttggggaatccaccacccctccagcacacaggagaagaacgacttgtatggcactcaaagcctatcaattagcgtgggatcatctacttaccaaaacaactttgtcccagtcgtgggtgccaggccacaagtgaatggccagagtggtcggattgatttccactggacgatggtccaacccggcgataacattacattttctcataatggaggcctcattgctcctaacagggtgtctaagctgaagggcagaggactcggaatccaatccggcgcctcagtggataatgattgtgagagcaagtgtttttggaaggggggttctatcaatactaagctccccttccagaacctgagcccacgcaccgtaggacaatgccccaaatacgtgaacaagaagtccctgctcctcgcaacaggcatgcggaacgttccagaagtggcacagggcagggggttatttggggctatcgctggttttattgagaacggatgggaggggatggtggatggctggtacggtttccgccatcagaacgcccaggggactggccaagcggcagactacaagtccacacaggcagccatagatcagataactggaaagcttaataggctcattgagaagacaaataccgagtttgaaagcatcgaatccgaattttccgagattgagcatcaaattggcaacgtaatcaactggacaaaggacagcattactgacatctggacgtaccaggccgaactgctggtggcgatggaaaaccagcacactatcgatatggcagatagtgaaatgctgaacttatatgagcgcgtgcgaaagcaactgaggcaaaacgctgaagaggacggcaaagggtgtttcgaaatttaccataagtgcgatgataattgtatggagagtatccggaataacacgtatgatcatacccagtatcgcgaagaagctctccttaacaggcttaatattaatccagtcaagctaagttccggatataaggacgtcattctctggtttagttttggcgcttcctgctttgtattgctggctgtgatcatgggcctggtcttcttctgtctcaagaacgggaacatgcgatgcaccatatgcatc

SEQ ID NO: 743 - DNA, 1683 bp, Influenza A virus
  misc_feature (1)..(1683): Codon Optimized Sequence Encoding H10 Hemagglutinin
atgtataaaattgtggtcatcatcgctttattgggagcagttaaggggctcgataagatctgtctgggccaccacgccgttgcaaacgggaccattgtgaagactctcaccaatgagcaggagaaagttactaatgcaacagagaccgtcgaatctacaggcctgaatcggctttgtatgaagggacgcaagcataaggacctgggcaattgccaccctataggcatgctaattgggacgccggcctgcgacttgcacctcacaggtacgtgggacactatcatcgaaagggagaacgctatcgcctactgttacccaggcgctaccgtgaacgaggaagcgctgagacagaaaatcatggaatccggtggaatcgataagatatctactggctttacttacggctcatccattaattccgctggcaccactcgcgcctgtatgcggaacggcggcaattccttctacgctgaacttaaatggctcgtgtccaagagcaaaggccagaactttccacagaccaccaatacttatagaaatacagacacggccgagcacctgatcatgtgggggatccatcaccctagtagtacacaggagaaaaatgacttatacggcacccaatcccttagtatatctgttgggtcaagcacgtacagaaacaatttcgtgcctgtagtgggcgccaggccacaggtcaacgggcagtcaggcaggattgatttccattggacactggtgcaacctggtgataatatcactttctcccacaacggcggtttaattgctcccagcagagtaagtaagctcatcggccgaggactcggcattcagagcgacgcacccatagataataactgcgaatctaaatgtttttggagggggggctctatcaatacacgcctcccttttcagaacctgtctcctaggactgtagggcagtgccccaagtacgtaaacaaaagatcgctgatgttagccaccgggatgcggaacgtccctgagctcattcagggaaggggcctgttcggagccattgcagggttcttggagaatggatgggaaggaatggttgacgggtggtacgggttccgacatcagaatgcccaaggcaccggacaggccgctgactacaaaagcacccaggcagccatagaccagattaccggcaaactaaatcgtttagtggagaagaccaataccgaatttgaatccatagagagcgaattcagcgagatagagcatcaaatcggcaatgtgattaactggacaaaagattccataaccgacatttggacttatcaggccgagttgctagtcgcaatggagaatcagcatacaatcgacatggctgactctgagatgttgaatctgtacgagagggttcggaagcagctgcggcagaacgccgaggaagacgggaaagggtgttttgagatctaccatgcgtgtgatgatagctgtatggaaagcattcgcaataacacctatgaccactcacagtatcgggaagaggcgttgttaaacaggctgaacatcaacccagtaacactgtctagcggttataaggacataatattgtggttctcctttggtgcaagctgctttgtcttgctggcggtcgtgatggggctggtgttcttttgtctgaaaaacggtaacatgaggtgtactatttgtatc

SEQ ID NO: 744 - DNA, 1683 bp, Influenza A virus
  misc_feature (1)..(1683): Codon Optimized Sequence Encoding H10 Hemagglutinin
atgtataagatcgttctcgtgttggctctactgggtgccgtccatggtttggacaagatctgcctgggccaccatgcagtgccaaacggtaccatagtgaaaaccttgactaatgaaaaagaagaggtgactaatgccaccgagaccgtggagtcgaaatccctcgataaactgtgtatgaagaacaggaactacaaggacctgggcaattgccatccaattggcatggtggtggggacacctgcctgcgacttacacctcaccgggacatgggacactttgatcgagagggataattcaattgcgtactgctatcccggggccactgtgagtgaggaggcgctgaggcaaaagatcatggagtctgggggcatagacaagattagcaccggcttcacatatggaagctccatcaactcagctggcacgacgaaagcttgcatgcggaacggtgggaactccttttattctgagctgaagtggttagttagcaagaacaaaggccagaacttcccccagactacaaacacatatagaaacacagactcagtggagcatttgatcatttgggggattcaccatccatcgtccacacaggaaaagaacgacctgtatggcacccaatcgctgagcatctcagtcgggtccagtacttatcagaataacttcgtgcccgtggtgggcgctcgcccacaggtaaacgggcaaagcgggagaatcgacttccattggactatggtgcagcctggggataatattaccttctcccacaatggaggtcttatagcccccaatcgagttagcaaactgaaaggccgaggactgggtatccagagcggcgcaagcgtggataatgattgtgagtccaaatgtttttggaagggaggatcaattaataccaaattgcccttccagaacttgagccctcgcactgttggccagtgtccaaagtacgttaacaagaaatcattactgctagccaccggcatgcgtaacgtgcctgaggtcgcccaggggcgcggtctcttcggagcaatagcaggattcatagagaatggttgggagggaatggtggacggctggtatggattccgccatcagaatgctcaaggaaccggccaggctgcggactataaaagcacgcaagctgcgatagaccaaattacgggaaagctgaaccgcctgattgaaaagaccaatactgagtttgaatctattgagtctgagttctccgaaatcgaacatcagattgggaatgttatcaactggactaaagacagtataactgacatttggacgtaccaggcggagcttctagtggccatggaaaatcagcacaccatagatatggcagattctgaaatgctgaacctctacgaacgagtgcgaaagcaattgcgtcagaacgccgaggaggacggcaagggatgtttcgagatttaccacaaatgtgacgacaactgcatggaaagcattaggaataacacttacgaccatacacagtacagggaagaggccctgctcaaccgcctcaatattaacccggtgaaactatcttctgggtacaaggatgttattctgtggtttagcttcggcgcctcctgttttgtactgcttgccgtgattatgggtttggttttcttctgcctcaagaatggcaatatgagatgtacaatttgcata

SEQ ID NO: 745 - DNA, 1683 bp, Influenza A virus
  misc_feature (1)..(1683): Codon Optimized Sequence Encoding H10 Hemagglutinin
atgtacaagatcgtggtcatcattgcgctcctgggtgccgtgaaagggcttgacaagatctgcctgggtcaccatgctgtcgccaatgggacaatagtgaagactcttaccaacgagaaggaagaagtcaccaacgcaacagagactgtcgagagtaccggcttaaacagactttgtatgaaagggcgcaagcacaaggacctggggaactgtcacccaattggcatgctgatagggtctccagcctgtgatctgcacctaactggcacatgggacaccctgattgagagagaaaacgccattgcatactgttatccaggtgccaccgttaatggggaggcattgaggcagaaaatcatggagtccggaggaatagacaagatatcaacagggttcacatatgagagctctatcaactcggctgggacaaccagggcatgtatgcgcaacggaggaaattcgttctatgccgagctgaaatggcttgttagcaagtctaagggccagaattttcctcagactaccaatacataccgcaacaccgacactgccgagcatctgattatgtgggggattcaccacccctctagtactcaggagaagaacgacttgtacgggacacaaagcctgtcaattagtgtcgggagctctacataccggaataatttcgttcctgttgtcggggcgaggccacaggtgaacggccagagtgggaggatcgacttccactggactctcgtccaaccaggggacaacatcactttcagccacaacggaggccttattgctccttcgagagtcagtaagctgattggcaggggtttgggcattcaaagtgatgccccaattgataataactgcgaaagcaagtgcttctggcgagggggctctattaatactcgattgccttttcagaacctgagcccgagaacagttgggcaatgtcccaagtacgttaataagaggtctctgatgctggcgacagggatgagaaatgtccctgagctgatgcaagggcggggactgtttggcgctatagcgggcttcctcgaaaacggatgggagggaatggttgatggatggtatgggttccgacaccagaatgcacagggcaccgggcaagctgctgattacaagtctactcaagccgccatcgaccagatcaccggcaaacttaaccgcctggtcgagaaaacaaatacagaatttgaatctattgaatccgagttctctgagatagaacaccaaatcggcaacgtgattaattggaccaaggatagtatcacagatatctggacctatcaagcggagctgctggtggccatggagaaccagcacacaatcgatatggctgactcagagatgcttaatttgtatgagcgggttcgcaagcagctccgacaaaatgctgaggaggatggaaagggatgttttgagatctatcatgcctgcgacgactcatgcatggaaagcattcgcaataatacctatgatcattcacagtacagagaagaggctctcctgaacaggctgaacataaaccccgttacactttctagcgggtacaaagacattatcttatggttcagtttcggagcatcttgcttcgtactactggccgttgtcatgggcctggtgttcttctgtctaaagaatgggaacatgcgctgcaccatttgcatt

SEQ ID NO: 746 - DNA, 1683 bp, Influenza A virus
  misc_feature (1)..(1683): Codon Optimized Sequence Encoding H10 Hemagglutinin
atgtacaagatcgtcgtgattatcgccttattgggagcagtcaaggggctcgataagatctgtttagggcatcatgcggttgcaaacggcactatcgttaagaccttgacaaatgaacaggaggaagtgacgaatgccactgaaaccgttgagtccactgggattaatcggctgtgcatgaaaggacgaaagcataaggaccttggaaactgccaccccattggcatgctgattgggacccctgcttgcgacctgcatctgactggaacctgggatacccttattgagcgagaaaatgccatcgcctattgctatccaggcgccacagcaaacgtcgaggccctcagacagaaaatcatggagtccggtggaattgacaaaatctctaccggctttacctacgggtctagcatcaattccgcagggactacgagggcatgtatgagaaatggcggcaacagcttctatgccgagcttaaatggcttgtttcaaaatccaagggacagaacttccctcagactacaaacacttatcggaatacagatacagcagaacacttgattatgtggggcattcaccacccaagcagtatccaggagaaaaatgacctctacggcacgcagtcactgagtatatccgtgggctcttcaacctacaggaacaattttgtccccgtcgtcggtgcgaggcctcaagtgaacgggcaatcgggaaggatcgacttccattggacactggtgcaacctggagataatatcacgtttagccacaacggaggcttgattgctccatccagagtgagcaaactgatcggcaggggcctagggatccaatcagacgcaccaatcgataacaactgtgagtctaagtgtttctggagaggtggcagcattaacacccggttgcccttccagaatttgagcccccggactgtcggtcagtgcccaaagtacgtgaatcggcgctctcttatgctggccaccggaatgaggaacgtccccgagctcatacagggccggggtttattcggggcaattgctgggttcctggagaacggctgggaaggcatggtggatggctggtacggatttaggcaccagaacgcacaaggcactggccaagccgcggactacaaatcaactcaagctgccatcgatcagataaccgggaagttgaacagactggtagaaaaaaccaataccgagttcgagtcaattgagtccgagtttagtgagatagaacaccagatcggtaacgtgatcaactggacaatggatagtattactgacatttggacctatcaagcagaactgctggtggcgatggagaaccagcacactatcgacatggcagacagcgaaatgcttaacctgtacgaacgggtgcggaaacagctaagacaaaacgccgaagaggacggcaaaggttgcttcgaaatctaccacgcctgtgacgactcttgtatggaaagcataaggaacaatacctacgatcactcccagtaccgagaggaggcgttactcaatagactgaacatcaaccctgtgaccctgagctctggatataaagacatcattctctggttttcttttggggccagctgcttcgtgcttctcgcagtcgttatgggactcgtgttcttctgcttgaagaacggtaatatgagatgcacaatctgcata

SEQ ID NO: 747 - DNA, 1683 bp, Influenza A virus
  misc_feature (1)..(1683): Codon Optimized Sequence Encoding H10 Hemagglutinin
atgtataagattgtcgtgattattgccctgttaggggccgtgaaaggactagataaaatttgcctgggccaccatgctgtcgccaatggcacgatcgttaaaactttaacaaacgagcaggaggaagtaacgaacgcaacagagacagttgagagtacaggaatcaatagactgtgtatgaaggggaggaaacacaaggatttaggaaattgccaccctatcggaatgctcatcggaactccagcatgtgatctgcatctgacaggcatgtgggacacactgatcgagcgggaaaatgcgattgcctattgctatcccggggctacagtgaatgtcgaggctctgcggcagaagatcatggaatccggcggcatcaataaaatttctactgggttcacttacgggagttctattaatagtgccggcacgaccagagcctgcatgcggaacggcggcaactcgttctatgcagagctgaaatggctggtttcaaaatctaaaggacagaactttccacaaacaacaaatacttataggaacaccgacaccgccgagcatctgattatgtggggaatccatcacccaagtagcacacaggaaaagaacgacctttacggcactcagtcactgagcataagcgttgggtcctctacttaccgcaataatttcgtgccagtcgtcggcgctagaccacaagtcaatgggcaatcagggagaatcgattttcactggacccttgtgcagcctggtgataatatcactttcagccacaacgggggcctgattgctccaagtagagtctccaagcttattggacggggactcgggattcagtctgatgctcccatagataataattgtgagtcgaagtgcttttggcgaggagggtccatcaacacgcggttgcccttccagaacctctcacctcggaccgtggggcagtgccccaaatacgtgaacaggaggagtctgatgctggccaccgggatgcgcaacgtgcccgaattgatccaggggagaggccttttcggcgctatagcggggtttttagaaaacgggtgggagggcatggtggacggctggtacggatttcgccatcagaatgcccagggtactggtcaagccgccgattacaaatctacccaggctgccatcgaccagattacaggaaagttgaaccgactggtggaaaagaccaacactgagtttgagagtattgaaagtgaattctctgagatcgaacaccagattgggaacgttatcaactggacgaaagattccatcacagacatctggacctaccaagccgaactccttgtggccatggagaatcaacacacgatcgacatggctgactcagaaatgctgaatttgtacgaaagagtgagaaaacagctgaggcaaaatgccgaggaggatggcaaaggctgtttcgagatttatcacgcctgcgatgattcctgtatggaatcaatcaggaataatacctacgaccactctcagtaccgcgaggaagccctattgaaccgacttaacataaaccctgtgactttgtccagtggttacaaggatatcattctttggttttcgttcggagcttcctgcttcgtactcctcgcggtggtaatgggcttattctttttttgcctaaagaacggaaatatgaggtgtacgatctgcatc

SEQ ID NO: 748 - DNA, 1683 bp, Influenza A virus
  misc_feature (1)..(1683): Codon Optimized Sequence Encoding H10 Hemagglutinin
atgtacaaaattgtggtgattattgctctgctcggagccgtcaagggcctggataagatctgtctgggccaccacgccgtggccaacggaacaattgtgaagacactcacaaacgagcaggaagaagtgactaatgccaccgagaccgttgaaagtaccgggataaaccgcctttgcatgaagggtcggaaacataaagacctggggaactgccaccctataggtatgcttattggaacacccgcttgtgatctacaccttactgggatgtgggacacccttatagagcgcgagaacgccatcgcatactgttatcctggtgccacggttaacgtggaggctcttaggcagaagatcatggagtcaggcggtattaataagatttccacaggctttacttacgggagctcaataaacagcgccgggaccacgagggcctgcatgcggaacggcgggaactccttttacgcggaattgaaatggctggtgtcaaagtccaaaggacaaaacttccctcaaaccactaatacctacaggaataccgacactgcagaacatcttatcatgtggggcatacaccacccgtcgtctacacaagagaagaacgatctttatgggacccagtctctgtccatcagcgtggggtcatccacttaccgaaataattttgtgcctgtggttggggctaggccacaggtgaatgggcagtctggccgtattgatttccactggacacttgtgcagccaggggataatataacattcagccacaatgggggcctaatcgctccatcccgggtgtctaagttgatcggtcgcggacttggaatccaatctgacgctccaatcgacaacaattgtgagtctaaatgcttttggcgcggcggctctatcaacactagactgccattccaaaatctgtctcctcgcaccgttgggcagtgtcctaagtatgtaaacagacggtccctgatgcttgcgacaggaatgcggaatgtacctgaactcatccagggaagagggctgttcggagctattgccggctttctggagaatggttgggagggaatggtagacggctggtacggctttcggcatcaaaatgcgcagggaacaggccaggcagcagactacaaatcaacccaggctgccattgaccagattacagggaagctcaatagacttgtggagaaaacaaacaccgagttcgaatccatcgagtccgagttcagtgagatcgagcaccagattgggaacgtgataaactggacgaaagattctatcaccgatatttggacataccaggctgagctcctggtcgccatggagaatcaacatacaattgatatggcggacagcgagatgctgaacctatatgagcgcgtacgaaagcaattgagacagaacgccgaggaggacggtaaggggtgctttgaaatatatcatgcttgtgacgactcatgcatggaatcaattagaaataatacatatgaccactctcaatatagagaggaggccctcttgaatcgcttgaacatcaatccggtgactctctctagtgggtacaaagacattatactgtggttcagtttcggggccagctgcttcgtgctgctggcagtagttatggggctcttctttttttgcctgaaaaatggcaatatgcgatgtaccatttgtatc

SEQ ID NO: 749 - DNA, 1683 bp, Influenza A virus
  misc_feature (1)..(1683): Codon Optimized Sequence Encoding H10 Hemagglutinin
atgtataaaattgtcgtgattattgccttgctaggcgccgtcaagggcctggacaaaatctgcctgggacaccacgctgtggcgaacggcactatcgttaagactctgaccaatgagcaggaaaaggtcacaaacgctacagaaacggtcgaatctacaggcctgaacaggctgtgtatgaaaggtagaaagcacaaagacctgggaaattgccacccaatagggatgttaatcggcaccccagcatgcgatttgcacctgacaggtacatgggacaccatcatcgaaagggagaatgccattgcttactgttatcccggagccacagtgaatgaggaggccctcagacaaaaaataatggaatccggcggaatcgacaagataagtacaggatttacctatgggagctctattaattccgccggcactacaagagcttgtatgaggaacggtggaaattcgttttacgcagagcttaaatggctagtgagcaagtccaaaggacagaactttcctcagacaacaaatacttatcggaacaccgatacggctgaacacttaataatgtgggggatccaccatccgtcgtcaacgcaggagaaaaatgatctgtacggtacgcaatcactgtccatctccgtaggcagctccacctacagaaataattttgttccagttgtcggtgctcggccacaagtgaatggccagagcggccgaatcgactttcactggaccctggtgcagccaggggataacatcaccttcagccacaacggtggccttatcgccccctctagggtgagtaagctgatcgggcggggcctcggaatccaatctgacgcacccattgataacaactgcgagagcaagtgtttctggcggggtggttctatcaatacccgactcccgtttcagaatctatctcctaggaccgtcggccagtgcccaaaatatgtgaacaagcgcagccttatgctagcaactggaatgaggaatgttcccgagctgattcagggccgaggtctcttcggagctattgccgggtttctcgagaacggatgggaaggcatggtggacgggtggtacggttttcggcaccagaacgcccagggaaccggacaagcagccgattacaagagcacccaggctgctatcgatcagattaccggcaagctcaatcgcttggtggagaaaaccaatactgaatttgagtccattgaatcagagttcagcgagatcgagcatcagatcgggaacgtcattaattggacaaaggatagcatcaccgatatctggacataccaggctgagcttctggttgcaatggaaaatcagcatactatcgacatggctgatagcgaaatgttgaatttgtatgaaagggtgcgtaagcagctgcggcagaacgccgaggaggacggcaagggatgcttcgagatctaccacgcatgtgacgactcatgcatggagagcattcggaacaacacttatgatcactctcaatatcgtgaagaggcactcctaaacagactaaatataaacccggtcaccctcagcagcggctataaggacatcattctttggttctcttttggtgcaagctgtttcgtcctcctcgccgtggttatgggcctggtgtttttttgcctgaagaatggcaatatgcggtgcaccatttgcatc

SEQ ID NO: 750 - DNA, 1683 bp, Influenza A virus
  misc_feature (1)..(1683): Codon Optimized Sequence Encoding H10 Hemagglutinin
atgtataagattgtggtgattattgcgttgctgggggctgtgaaaggcctggataagatctgtcttgggcatcatgccgtagctaacggcacaattgtgaaaactctgacaaatgagcaggaggaggtgacaaacgcaaccgagaccgttgagagcacagggattaatcgcctgtgcatgaaggggcgcaaacacaaggacctggggaactgtcaccctatcggaatgctgatcgggaccccagcctgtgatttacacctaacaggaatgtgggacacactcattgaaagagagaacgcgatagcatactgctaccccggagctactgtgaatgtggaagcactgcgccagaagattatggaatccggaggcataaataagatttccactgggttcacctatggctcctctatcaacagtgcaggaacgacgagagcctgcatgcgcaatgggggaaatagtttctacgccgagctgaagtggctggtgtctaagtcaaagggtcaaaactttccccaaactaccaatacgtaccgaaatactgacacggcagaacacctaataatgtgggggattcaccatcccagcagcacccaggagaagaatgatttgtatgggactcagtctctgtcgatttccgtgggcagcagcacgtaccgaaataatttcgtacccgtggttggagctcgacctcaggtgaacggccagtccggcagaattgattttcactggacactagttcagccaggcgataatataacattttcgcacaacggaggtctgatcgcaccttcacgcgtgtccaagcttatcggtcggggcctggggatccagagtgatgctcccatcgataacaattgcgagtctaaatgtttttggcgaggtggatccatcaatacccgtctgcccttccagaacctgtctccacgcacagtcggtcagtgccccaagtatgtgaatagaaggtccctgatgctcgccacaggaatgagaaacgttccggaactaattcagggccgtggactattcggggccatagcagggttcctggagaatggctgggagggtatggttgacggttggtacggctttcggcatcagaacgcccaagggaccgggcaggccgccgactacaaaagtacccaggctgcaatcgaccagatcacggggaaactgaaccgactcgtggagaagactaacactgagtttgagtccatcgagtctgagtttagcgaaatcgagcatcagattgggaacgttattaactggacaaaggacagcatcaccgatatatggacctaccaggcagaactattagtggcaatggagaaccagcacacaattgacatggcggacagcgagatgctgaatctttatgagcgtgtccggaaacagctgagacagaacgccgaagaagatggcaaaggctgctttgagatataccatgcgtgcgatgattcatgcatggagtctattcgcaataatacatacgatcacagtcagtacagagaggaagctctactgaatcggctcaacatcaatccagtcaccctgtcttccggctacaaggacatcattctgtggttcagctttggagcctcctgttttgtacttctagccgttgtgatgggcttgttttttttctgtttgaagaacgggaatatgagatgtaccatctgcatc

SEQ ID NO: 751 - DNA, 1683 bp, Influenza A virus
  misc_feature (1)..(1683): Codon Optimized Sequence Encoding H10 Hemagglutinin
atgtacaagatcgtggtaattatcgctctgctaggagccgtgaaggggctagacaagatatgtctcgggcaccacgccgtggttaacggaaccattgtgaagacattgactaacgaacaggaggaggtgaccaatgcgacggaaacagttgagtcaacaggattgaataggctgtgtatgaaggggcgtaaccacaaagacctgggcaattgccatccaatcggaatgcttattggaactcccgcttgcgacttacacctgaccggcacatgggataccctgatagaaagagaaaacgctattgcgtattgctacccaggagctaccgtaaacgaagaggcccttcggcagaaaataatggagtccgggggaattaacaaaatatctactggctttacttatggatcgtccatcaacagcgctggaactacacgcgcttgcatgcgtaacggaggtaattcattttatgccgaactgaagtggctggtgtcaaagtcaaagggacagaacttcccccaaactacaaatacatacaggaataccgacactgctgaacacctgattatgtggggtattcaccacccctcaagcacccaggaaaagaatgacctgtacggaactcagagtttgtctatcagcgtgggaagttcaacctaccaaaataacttcgttccggtggttggcgccaggccccaggtgaacggacagtcggggcgcatcgactttcattggactttagtccagcctggcgacaatatcacattctcccacaacggagggcttatcgccccgagtcgcgtgagcaagctcattggtcgggggttgggaattcagagcgatgcccctattgacaacaactgcgaaagcaagtgcttctggagaggcggttctattaacacaagactcccattccaaaacctgagcccacggacagtcgggcagtgccccaagtacgtaaataaaaggtcactcatgttggctaccgggatgcggaatgtcccagaactgatgcagggaagggggctgttcggcgcaatcgccggctttattgagaatggctgggagggaatggttgacggatggtatggtttcaggcaccagaatgcccagggtaccggtcaggcagccgattataaatccacccaggcagcgattgaccagattactggaaagttgaaccggcttattgaaaaaaccaacactgagttcgagagcatcgagagtgagttcagcgagatcgaacatcagatcggtaacgtgataaactggaccaaggactccatcactgatatttggacctaccaggctgagttattggttgccatggagaaccagcacaccatcgacatggccgattctgaaatgctgaatctctatgagagagttcggaaacagctgagacaaaatgcagaggaggatgggaagggctgttttgagatttaccacgcctgtgacgacagttgtatggagtctattagaaataatacctacgatcattctcaatatcgagaagaggccttgttaaataggctgaatattaacccagtcaccctaagcagcgggtacaaagatatcatactgtggttctcgtttggagcctcttgctttgtgctattggcagtcgtgatgggtttggtgttcttctgcctcaaaaacgggaatatgagatgtacgatttgcatc

SEQ ID NO: 752 - DNA, 1683 bp, Influenza A virus
  misc_feature (1)..(1683): Codon Optimized Sequence Encoding H10 Hemagglutinin
atgtataagattgtccttgtgctcgccctgctcggagcagtgcacggcctcgataaaatctgtctggggcaccacgccgtgcctaacggcaccatcgtcaagactctcacaaacgagaaggaggaagtgacaaacgctactgaaacagtagaaagtaagagcctggacaaactttgcatgaaaaacaggaattataaagacttgggtaattgtcacccgattggcatggtcgtcggaacgcctgcttgtgacctccatctgacgggaacctgggataccttgatcgagcgggacaactcaattgcatactgctatccaggcgccaccgttagtgaggaggctttgagacagaagatcatggagtctggagggattgacaaaatttccaccggctttacatatggtagctcaatcaactcggctgggactacaaaagcttgtatgaggaacggtggaaatagcttttactcggaactaaaatggttggtgtctaaaaacaagggtcagaactttcctcagacgaccaacacttatcgaaatactgactccgtggagcacctgattatttgggggatccatcatcccagcagcacacaagagaagaatgacctgtatgggacgcagtctctgtccattagcgtcggcagttcaacttaccagaataatttcgtgcctgtggtgggagcgcgcccccaagtcaatgggcagagcggaaggattgatttccactggactatggtccagcccggcgataacattactttcagccacaacggagggctcattgcaccaaaccgtgtctcaaaactgaagggcagggggcttggtattcagagcggagctagtgtggacaatgactgcgaatctaagtgtttttggaaaggaggatcaattaacactaagcttccgtttcaaaacctgagtccacgcacagtcggacagtgccctaaatatgtgaacaaaaagtcgcttctgctagctaccgggatgaggaacgtgccagaggtcgcccagggcagaggtttgttcggcgcgatcgccggtttcatcgaaaacggatgggagggaatggtggatggctggtacggatttcgtcatcaaaacgcacagggaacgggtcaggccgcagattataaatctactcaggccgctatagatcagatcacaggcaagctgaataggttaatagagaagacgaataccgagtttgagagcatcgaaagcgagttcagtgaaatagagcatcagattggcaatgtgatcaattggacaaaagattcgatcactgatatttggacatatcaggcagaacttcttgtggcaatggagaaccagcatacgattgatatggccgattcggaaatgctgaatctttacgagagagtcagaaaacagctgcgccaaaatgctgaggaagacgggaaggggtgctttgaaatataccataaatgtgacgacaactgcatggagtcgatccgcaacaacacatatgaccatacccagtaccgtgaggaagctctgttaaatagacttaacatcaatccagttaaactgtcctctgggtataaagatgtgattttgtggttctctttcggcgcttcatgctttgtcctcctcgccgtcatcatgggactggtgtttttttgcctcaaaaacgggaatatgcgatgtacgatatgcatc

SEQ ID NO: 753 - DNA, 1683 bp, Influenza A virus
  misc_feature (1)..(1683): Codon Optimized Sequence Encoding H10 Hemagglutinin
atgtataaaatagtagtgatcatcgctctgttaggagcggtgaaagggctcgacaagatttgtctgggccaccacgccgttgctaacggcaccatcgtcaagaccctcactaatgaacaggaggaggtcactaacgccactgagacagttgaatcgaccgggattaaccggttgtgtatgaaaggccggaagcataaagatctcgggaattgccacccaatagggatgcttatcggcacaccagcatgcgacctccatctcacgggcatgtgggacacccttatcgaaagagaaaatgccattgcctattgctatccgggcgcaaccgtgaatgtggaggcccttcgacaaaaaatcatggaaagcggcggcattaacaaaatcagcacgggattcacctacgggtctagtatcaattcagcaggcacgaccagagcttgtatgcgtaacgggggtaattctttctacgcagagctgaaatggctcgtgtctaagagcaaaggtcagaattttccccagactactaatacatataggaataccgacactgcggagcatcttataatgtggggcatccaccacccatcctccacacaggaaaagaacgacctgtatggtacgcagtcactgagtataagcgttgggtccagcacttatcgaaataactttgtgcccgtagtgggagcccgcccacaggttaacggccagagtggcagaatcgacttccattggaccctggtgcagcccggcgacaacatcactttctcacataacggagggttaatagctccatccagggtatccaaactcattggtagggggctgggcatccaatccgacgcccccattgacaataattgtgagagcaaatgtttctggaggggtggaagcatcaataccagactcccattccagaatttatctccccgcacagtagggcagtgccccaaatatgttaacagaagatccctgatgctcgcgacaggaatgcggaatgtgcccgagctgatccagggccgcgggttgtttggcgccatagctggttttctcgagaatggttgggaagggatggttgacggctggtatgggtttcgccatcagaacgctcagggaacaggacaagctgccgactacaagagcactcaagcagcaatcgatcaaatcacggggaagctcaacaggcttgttgaaaagactaatactgagttcgaaagcattgagtccgagttttccgagattgagcatcagattgggaacgtcatcaactggaccaaagacagtatcacggacatatggacttatcaagccgaactcctggtggccatggaaaaccagcacacaatcgatatggctgattctgagatgcttaacctgtacgagcgcgtgcggaaacaactgcggcaaaacgcagaggaagacggaaaaggatgttttgaaatataccacgcatgtgatgatagctgcatggagagcattcgtaacaacacttatgatcattctcagtaccgcgaggaagctctcctaaacagactcaacattaatccagtgaccctgagctctggatataaagacattattctgtggtttagtttcggcgccagctgctttgtgctgctggcggtggttatgggactgttcttcttctgtttgaaaaacggaaatatgagatgtactatttgcatc

SEQ ID NO: 754 - DNA, 1683 bp, Influenza A virus
  misc_feature (1)..(1683): Codon Optimized Sequence Encoding H10 Hemagglutinin
atgtataagatagtagtaattattgctctcttgggggcggtgaaagggctggataaaatctgcctggggcatcacgccgtggccaatggcaccattgtaaaaacgcttacaaatgagcaggaagaagtgaccaacgccacagaaactgtggagagcactggcatcaaccggctctgtatgaagggtagaaagcacaaggatctggggaattgccaccccatcggcatgttaataggcactccggcttgcgatttgcaccttaccggaatgtgggacacactaatcgagagggaaaatgccattgcgtactgctacccaggtgccaccgtgaatgtcgaggcactgaggcagaaaatcatggaatcaggaggaataaacaagatctctaccggctttacgtatggctcatccatcaactctgcaggtaccactcgagcttgcatgcggaacggcggcaattccttctacgcagaactaaagtggcttgtgtccaaaagtaagggtcagaatttcccccaaactaccaatacgtacaggaacactgacacggcagaacacctgatcatgtggggcatccatcatccctcctctacccaggaaaaaaatgacctgtacgggacacagagcctgtccatatctgtaggctcaagtacatatcgtaacaacttcgtgcccgttgtgggcgcacgtccacaggttaacggccaaagcggacgcattgatttccattggaccctagtccagcccggagacaatataaccttctcgcataatggaggactgatcgctccctctcgcgtgtctaagctgatcggtcggggattggggattcagagcgacgctcctattgataacaactgcgaatccaagtgcttttggagagggggcagcatcaatactagattgccttttcagaacctttctccccgcacagtggggcaatgccctaaatacgtcaatagaaggtctcttatgcttgccaccggaatgcgtaatgtaccagaactcatacaaggtagagggttattcggcgccatcgctggctttctggaaaatggctgggaggggatggttgacggctggtatggtttcagacaccaaaatgctcagggtacaggtcaggccgccgattacaagtccacacaggcagctattgatcagatcacaggcaagttgaaccgcctcgtggaaaagactaacacagagtttgagtctattgaatccgaattctctgagattgaacaccaaattggaaatgttatcaactggacaaaggactctattaccgatatttggacctatcaagccgagttgttggtcgccatggagaatcaacatactattgacatggcggactctgaaatgctaaatctctacgagagagtaagaaagcagcttcgacagaacgcagaggaagacggaaagggatgttttgagatctatcatgcttgtgacgattcgtgcatggaatccattcggaataatacatatgaccattctcagtatagagaagaagccctgcttaaccggctaaacatcaatcccgtgacgctatcatccgggtataaagatatcatcctgtggttctcattcggggcttcgtgttttgtgctcctggcggtcgtgatgggcctgttctttttctgtcttaaaaacgggaacatgcgatgcaccatatgcatc

SEQ ID NO: 755 - DNA, 1683 bp, Influenza A virus
  misc_feature (1)..(1683): Codon Optimized Sequence Encoding H10 Hemagglutinin
atgtacaaggtcgtagttattatcgcgctgctaggtgcagttcgggggctcgataagatttgcctggggcaccatgcggtcgccaacggaactatcgttaagacattaaccaacgaacaggaggaggtgacaaatgcaaccgagaccgtggaatctaaatccctgggtaagctgtgcatgaaagggaggagttataacgaccttggaaactgtcacccaatcggcattcttatcgggacccccgcttgtgatctccatttaaccggcacctgggatacactcattgagcgcgaaaatgctgttgcctactgttacccaggagctacagtaaacgaggaagctcttagacagaagataatggagtccggagggatttccaagatcagcactggcttcacctatggcacatcaatcaacagcgcagggacgacaaaggcctgtatgaggaacggcggcaactcattctacgccgagctgaaatggctggtgtcaaagaacaaaggccagaacttcccacaaaccacgaacacctacaggaacaccgataccgcagagcatcttataatatggggaatccaccacccctcttccacccaggagaaaaatgatctttatggcactcaatctttatctatatcagtagggtcttcaacttaccagaacaatttcgtgcctgtggtgggagcgcggccgcaagtgaacggtcagagcggtcgtatagactttcactggaccctgctgcagccaggtgacaacatcaccttctctcacaatggtgggctaattgctccctccagagtcagcaagcttatagggagaggcctcgggatacagtcagaagcccctatcgacaatgggtgcgagtcgaagtgtttctggaagggtggatctattaacacaaaacttccttttcagaacttatctccgaggactgtgggccaatgccctaaatacgttaacaagcgcagtttaatgcttgctacgggtatgaggaatgtcccagagatcatgcacggccgcgggctcttcggggccattgccggatttattgagaacgggtgggagggcatggtagatggatggtacgggttccgccaccaaaacgcacagggaacgggacaggcagctgactacaaatcaacacaagcggctatcgaccagataacaggcaagctgaatagactgatcgagaaaactaatacagagttcgagagcatagagagcgaattttccgagatcgagcatcagatcggtaacattataaattggactaaggatagcattactgatatttggacctatcaggctgagctgctggttgccatggaaaaccaacatacaatcgatatggccgattcagaaatgctgaatctatatgagagagtgaggaagcagctgagacagaacgctgaggaggacggtaaaggctgtttcgaaatttaccatgcatgcgacgactcttgtatggaatctatccgcaacaacacatacgaccactcccagtacagggaggaagccctgctgaatcgactgaacattaatccagtcaagctttcctctggttataaggacatcatcttatggttcagcttcggggcttcgtgtctcattctcttggctgtggtaatgggcttagttttcttttgtcttaagaacggcaacatgaggtgcacaatttgcatc

SEQ ID NO: 756 - DNA, 1683 bp, Influenza A virus
  misc_feature (1)..(1683): Codon Optimized Sequence Encoding H10 Hemagglutinin
atgtataaaatcgtggttattattgcactgctaggggccgtcaagggcttagataagatttgcctgggccaccacgcggtggccaatgggaccattgtgaaaactctgaccaacgagcaggaagaagtgactaacgccaccgagactgtggaatcaacaggaatcaatcgtctgtgcatgaaaggcagaaagcataaggaccttggaaactgtcatcctattgggatgctgatcggcaccccagcttgtgatttgcacctcaccggtatgtgggatactcttatcgaaagggaaaacgctatcgcttattgttacccaggagcgactgtcaatgtcgaggccctacgccagaaaataatggaaagtggagggattaataagataagcactggtttcacgtatggcagttcgatcaatagtgccggaacaactcgcgcttgcatgcgtaatggtggaaactcattttacgcagagctcaaatggctagtttcgaagtccaaaggtcagaactttccacagacgaccaacacctatcgcaataccgacactgcagagcacctgatcatgtggggaattcatcacccgtcaagcactcaagagaagaacgatctttatggaacccagagtctcagtatttccgttggctcgagtacgtaccgcaataacttcgttcctgtcgtgggtgccaggcctcaggttaacgggcagtccgggcgcatcgattttcactggactctcgttcagcccggggataatatcacattcagtcacaacggtgggctgatcgcgccgtccagagtgtcaaaactgatcggcaggggcctgggcattcagagcgacgcaccaattgataacaattgtgagagcaaatgtttctggcgtggaggcagcatcaatacccgactcccgtttcagaatctgagccccagaactgtcggacaatgtcctaaatatgtgaatcggcgctccctgatgctcgcaactggcatgcggaacgtgcccgagttgattcaaggacgcgggctgttcggtgccatcgctgggttcctggaaaacggctgggaaggcatggtagatggatggtacgggttcaggcaccagaacgcccaagggacaggacaggccgccgactacaagagtactcaagctgctattgaccaaattaccggaaaactgaataggctggtggaaaagaccaatacagagttcgagtctatcgagagcgagtttagcgagatcgagcatcagattggtaatgtgattaactggacgaaagatagtatcaccgacatctggacatatcaagcagaacttcttgtggctatggagaatcaacatactattgacatggctgatagcgagatgttgaatctttacgagagagtgcgcaaacagctgcggcagaatgctgaggaagatggcaaaggttgtttcgagatctaccatgcctgcgacgacagttgtatggagagcattaggaataacacttacgaccactcacaatatcgagaagaggctctactcaacaggctaaacatcaatccagtgaccctctcctccggttataaggatatcattctctggttctccttcggagcttcctgttttgtccttctggcagtggtgatgggattattttttttctgccttaagaatgggaatatgagatgtacaatctgtatt

SEQ ID NO: 757 - DNA, 1683 bp, Influenza A virus
  misc_feature (1)..(1683): Codon Optimized Sequence Encoding H10 Hemagglutinin
atgtacaagatcgtagtgattatcgcattacttggcgccgtgaagggactcgataagatttgcttgggccatcatgctgtggccaatggcactatagtgaagacactcaccaatgaacaggaagaagtgaccaacgccaccgagaccgtggagtctacaggcatcaacaggctctgtatgaagggccgtaagcacaaggatcttggcaactgccatcctatcggaatgctcattggaacaccagcttgtgatctccacttaacaggcatgtgggacacactgattgagcgggagaatgcgattgcctactgttatcccggggccaccgtgaacgttgaggctctcagacagaaaatcatggagagcggcgggataaacaagataagcacaggcttcacttacggttctagcattaattcggcaggaaccacacgggcctgcatgcgcaacggcggcaattcattttacgccgaacttaagtggctggtgtccaagagcaagggccagaacttcccccagaccactaatacttaccgcaacaccgacacagcagagcaccttatcatgtggggtatacaccatcctagcagtacccaagaaaaaaacgatctgtacggaacacaaagcctttcaatttctgtaggaagttccacatataggaacaactttgtcccggtggtgggcgctggccctcaggttaatggccagtccgggaggatcgatttccattggacactcgtgcagcctggggacaacattactttctctcacaacgggggtttaatcgccccctcaagggtctctaagctcatcgggcgcggtctgggaatccaatccgacgctcctattgacaacaactgcgagtcaaagtgcttctggagaggtggatccatcaacacgcgcctcccatttcagaacttgtccccgcgtacagtgggccagtgtcccaagtatgtgaatcgacggagcttgatgctggccactgggatgaggaacgtgcctgaacttatccagggaaggggcctcttcggagccatcgctggcttcctggaaaacggctgggaggggatggtggacgggtggtacggctttcgacatcagaatgcccaggggactggacaggcagcagattataagagtacccaagccgccattgaccagatcacagggaagctaaacaggttggtcgaaaagactaacacagaattcgaatccatcgagagcgagttttccgagattgagcaccagatcggtaacgtgattaactggacgaaagactcaataaccgatatctggacatatcaggcggagttgcttgtggcgatggagaaccagcacactattgatatggcagactctgagatgctcaacctgtatgagcgggttcggaagcagctgcgacaaaatgctgaggaagacggaaaggggtgtttcgaaatctatcacgcctgtgatgactcttgcatggagtcgattaggaacaatacctatgatcactctcaatatagagaggaggctttactaaatcggctcaacataaatccagtgaccctgtccagcggatataaagacattattctatggttctctttcggagcgagctgctttgtgcttctcgctgtggtgatgggtctcttctttttttgcctgaagaatggtaacatgcgctgcactatttgtatt

SEQ ID NO: 758 - DNA, 1683 bp, Influenza A virus
  misc_feature (1)..(1683): Codon Optimized Sequence Encoding H10 Hemagglutinin
atgtacaaggtggtagtgattattgccctgctgggagcagttagaggcttagataaaatttgcctcgggcatcatgctgttgctaatggtacaattgtcaagaccttaacaaatgagcaggaggaggtaaccaatgcgaccgagacggtggagtctaagtctttggggaaactgtgtatgaagggaagatcatataacgacctaggcaattgccaccccatcgggattctgattgggacccccgcctgtgatctgcacctgacaggcacatgggacaccctgatcgaacgggaaaacgcggtggcctattgctaccctggggcgacagtcaacgaggaagctttgaggcagaaaatcatggagagcgggggcatctctaaaatctccaccgggttcacgtatggtacctccattaattcagccggaacgaccaaggcatgtatgcgtaatggaggcaactccttctacgccgagctcaagtggcttgtttccaaaaataaggggcagaatttccctcagacaacgaacacataccggaatactgacactgcagagcacctaatcatctggggaattcaccacccatccagtacgcaggaaaaaaacgacctctacgggactcagtctctgtcaatttctgtgggctcctcaacataccaaaataacttcgttccagtggtgggcgcccggccccaggtcaatggacagagcggaaggatagacttccactggacactccttcagccgggggacaatatcacgttctctcacaacgggggactgatagctccatctagggtgagcaaactgattggacggggattgggcatacaatcagaagcgcccatagacaatggatgcgaaagcaaatgcttttggaagggaggttcaataaacacaaaactcccattccagaatctgtctcctagaacagtggggcagtgccccaaatatgttaataagagatctctcatgcttgctactggcatgcggaacgtccccgaaattatgcatgggaggggcctcttcggggcgattgccggcttcattgaaaatggctgggaaggaatggtcgatggatggtatggctttcgacatcagaacgcacagggcactgggcaggcagcagactacaaaagtactcaggccgcaatagaccagataaccggaaagctcaatcgcctcatcgaaaagacaaacactgaattcgaaagtattgaatccgaattctctgaaatagagcaccagattggtaatatcatcaactggaccaaggatagtattactgatatctggacataccaagccgaactgctggtagcaatggagaatcagcacacgattgatatggcagattctgaaatgctgaacctgtatgagcgagtgcgcaagcagctgcgccaaaacgctgaagaggatgggaaaggctgcttcgaaatctaccacgcttgcgacgattcctgcatggagagtatccggaataacacctacgatcatagccagtacagggaggaagcccttctgaacagactgaacattaacccagttaagcttagtagtggatacaaagacataatcctctggttctcctttggcgcttcatgcttaattttacttgccgtcgtaatgggactggtgtttttctgccttaagaacggcaatatgaggtgcacgatttgcatc

SEQ ID NO: 759 - DNA, 1683 bp, Influenza A virus
  misc_feature (1)..(1683): Codon Optimized Sequence Encoding H10 Hemagglutinin
atgtacaagatcgtggttattattgccttgttgggcgccgtgaagggtctcgataagatttgtctgggccatcatgctgtagccaatggcaccattgtgaagacgctcactaacgagcaggaagaggttacgaacgcaaccgagacagtggagagcactgggataaacagactgtgcatgaaaggacgtaaacacaaggaccttggtaattgccaccctatcgggatgctgattgggacacccgcatgcgacttgcatttgaccggaatgtgggatacattgattgagcgcgagaacgcaattgcctactgttacccaggagccaccgtcaatgttgaggccctgcggcagaagatcatggagagcggcggcattaacaagatatctacaggctttacatatggatcatccataaattcagcaggaactacgcgcgcatgcatgcgcaacggcggcaacagcttttacgctgagcttaagtggctcgtcagtaagtcaaagggccagaatttcccccaaaccaccaatacatacagaaacaccgacacggcagagcacctgatcatgtggggaatccatcacccatcttccacgcaagagaagaatgacctatacgggactcagagcctctccatatccgtcgggtcctccacctacaggaacaactttgtacctgttgtaggggctcgcccccaggtgaatggccagagcggacggatcgactttcattggacacttgttcagcccggcgacaacattactttctcccacaacggaggtctgatcgcccccagcagggtaagtaaactgattggccgcggcttaggaatacagagcgacgccccaatcgataacaattgtgaatctaagtgcttttggagggggggcagtataaacacccggctaccctttcagaatctgagtccacgcaccgtggggcagtgtccaaagtatgtgaaccggagaagtttaatgctggcaaccggcatgagaaatgtccctgagctaattcagggtcgcgggcttttcggcgcaatcgcaggctttctcgaaaacggttgggagggcatggtggacgggtggtacgggttccggcaccaaaacgcccagggaactgggcaggccgccgattacaaaagcactcaggcagctatagaccagatcacaggcaaactgaatcggctggtggaaaagacaaatacagagttcgagagcattgagagcgagtttagcgagatcgaacatcagatcgggaacgttattaactggaccaaggatagcatcactgatatttggacctaccaggctgaactgttggtcgccatggagaaccagcacacaatcgacatggcagactcggagatgcttaacctctatgagcgggtgagaaagcagctccgacagaacgccgaagaggacgggaaggggtgcttcgaaatttatcatgcatgtgacgatagttgtatggagtcaatccgcaataatacttatgatcatagccagtatcgtgaggaggccctgctcaatcgtctgaatataaatcccgtgaccctgagttcgggctacaaagacataatactctggttttcgtttggcgcgagttgcttcgtgctgttagctgttgtaatgggattgttctttttctgcctaaaaaacggcaacatgaggtgtactatttgcatc

SEQ ID NO: 760 - DNA, 1683 bp, Influenza A virus
  misc_feature (1)..(1683): Codon Optimized Sequence Encoding H10 Hemagglutinin
atgtacaagattgtcctggtgcttgctctgctgggagccgtgcacggcctcgataaaatctgcttaggccaccacgctgtccctaatggcaccattgttaagaccttgacaaacgaaaaggaagaggtgaccaacgccactgagactgtggaatccaagtcactcgacaaattatgtatgaagaacaggaactataaagatcttggtaactgccatccaattggcatggtggtaggaactcctgcttgcgatctacacctgacgggcacatgggacaccctgattgagagggacaactctattgcatactgctatccaggtgcgaccgtttccgaagaagcactccggcagaagattatggagtccggcggcatcgataaaatctccaccggcttcacatacggaagtagcatcaactctgctgggacgaccaaagcgtgtatgaggaacggggggaatagtttctactcagaactcaagtggctggtcagtaagaacaaggggcagaacttccctcaaacgaccaacacataccgaaatacagattctgtggagcacttaatcatctgggggattcatcatccatccagcacgcaggagaaaaacgatctctatggtacacagtctctcagcatcagtgtgggaagcagtacgtatcagaacaattttgtccccgtcgttggcgcccggccacaagtgaacggacaaagtggtcgtattgattttcattggaccatggtccaacctggtgataatataacattttcacacaatggaggactgatagctcctaacagagtatccaagctgaagggaagggggttggggattcagtccggagcatcagtggacaatgattgcgagagcaagtgcttctggaagggaggttccatcaacacgaagctgcctttccagaatctgagcccacgaacagtgggacagtgcccgaagtatgtgaataagaagagccttctgcttgcgactggcatgaggaatgttcctgaagttgcgcagggaagggggctattcggggcaatcgccggattcatcgagaacggctgggagggcatggtggacgggtggtacgggttcaggcaccagaacgcccagggtacagggcaggccgctgattacaagtcaacacaggcggcgatagaccagatcaccggcaaactgaataggctaatagagaagactaacactgaatttgaatctattgagagcgagttctcggaaattgaacaccagatcggaaatgtgatcaattggaccaaggattccattaccgatatctggacttatcaggcagagctgttagtggcaatggaaaaccagcataccatagacatggctgattctgagatgttgaacctctacgagcgggtacggaaacaactgagacagaatgcagaggaagacggcaagggctgtttcgaaatctaccacaagtgcgacgataattgtatggaaagtatacgcaacaatacctatgatcacacacaatatagggaagaggctcttctgaaccgactgaacatcaatcccgtgaaacttagctcaggatacaaggacgtgatcctttggttttctttcggggctagttgcttcgtgctgcttgcggttatcatggggcttgttttcttttgtctaaagaatgggaatatgagatgcacaatctgcatc

SEQ ID NO: 761 - DNA, 1683 bp, Influenza A virus
  misc_feature (1)..(1683): Codon Optimized Sequence Encoding H10 Hemagglutinin
atgtacaaaatcgtggtgatcatcgccctcctgggagctgtgaagggccttgacaaaatctgcctcggccaccacgccgtcgccaatggaaccatcgtgaagactctgaccaatgagcaggaggaagttaccaatgcaactgagaccgtggaaagtaccgggataaatcgcctctgcatgaagggaaggaaacataaagacctggggaactgtcatccgattgggatgctgattgggacccctgcctgtgatttgcaccttaccggcacatgggacacactgatcgagcgagaaaatgctatcgcatattgttatcccggggcaaccgcaaacgtagaggccctacggcagaaaattatggagtccggtggcatagacaaaataagcacaggatttacctacggctcgagcatcaactctgctggcaccaccagagcttgcatgaggaatggcgggaactccttttacgctgagttgaagtggctggtgagcaagagtaaagggcagaactttcctcagacgactaatacatatagaaacaccgacacagcagagcacctcataatgtggggaatccatcacccatcttcaattcaggagaagaatgacctttatggtactcagagcctcagtatttccgtgggatcttctacgtacagaaacaactttgtgccagttgtcggcgcaagacctcaggtcaacgggcagtcagggagaattgactttcattggacactggtgcaacctggggataatatcacttttagccataatggaggactgattgctcccagtagagtctctaaactgattgggaggggactcggtatccagtcggatgctcctatcgataataactgtgagagcaagtgtttttggcgagggggatctatcaatacacggttgccatttcagaatctatcgccccgcacggttggtcagtgccccaagtacgttaatcgtcggtcgctgatgctggctacgggaatgaggaatgttccagaactgattcaaggacgcggtttgttcggcgccatcgcaggtttccttgaaaacggctgggaaggtatggttgacggttggtacggattccgacatcagaacgcccagggtacgggacaggcggctgactacaaaagcacccaggcagcaattgatcagatcacggggaagctcaatagactggtggaaaagaccaacacggaatttgaatcaattgagtccgaattttccgagattgaacatcagatcggcaatgtcattaattggacaatggatagcatcactgacatatggacttatcaggccgagctgctggttgcaatggagaatcagcacactatcgacatggctgattccgagatgctgaacctttacgagagagtgcgcaagcagctccggcagaacgccgaagaagatggaaaggggtgctttgagatttatcacgcgtgcgacgacagttgcatggaatccatccggaacaatacttatgatcattctcagtaccgcgaggaagcactgctcaacagactgaatattaacccagtgaccctaagctcagggtacaaggacatcattctgtggttctctttcggcgcgtcatgcttcgtgctgctggcagttgtgatgggactcgtgttcttttgcctcaaaaatggaaacatgagatgtaccatttgtatc

SEQ ID NO: 762 - DNA, 1683 bp, Influenza A virus
  misc_feature (1)..(1683): Codon Optimized Sequence Encoding H10 Hemagglutinin
atgtataaagtcgtagtgatcatcgcactgttaggagctgtaaagggactggacaagatctgcttaggacaccacgcagtggcaaacgggaccatagtcaagacattgactaatgaacaagaggaagtcaccaacgcgactgaaacagtcgaatctacaggaatcaacagactttgtatgaaaggacggaaacataaagatctgggcaactgtcaccccataggaatgctgattggtacaccagcttgtgacttgcatctgaccggcacatgggacacgctgatcgagagagaaaatgccattgcctactgttaccctggggctacagtaaacgtcgaggcgctgcgtcagaagatcatggaatctgggggcatcgataaaatcagcacggggttcacatacggatccagtattaattctgctggcactacccgtgcttgtatgcggaacggtggaaactccttctatgcagagctcaaatggctggtttctaagaacaaggggcagaattttccccagacgacaaatacatatagaaatacagacactgctgagcacctaatcatgtggggcatccaccacccaagtagtatccaggagaaaaacgacctgtacggcacacaaagcctgtcaatctcagtgggctcctcaacttaccgcaataattttgtgccagttgtgggcgccaggccccaggttaatggtcagtctgggcgcatcgattttcattggactctggtgcaacctggcgacaatattacattctctcacaacggaggactcatcgccccatccagagtgtctaagttgataggacgagggttaggcatccaaagcgatgcccccattgacaataactgcgaatcaaagtgcttttggcggggaggatccattaacacacggttgcctttccagaatctgtctccaaggaccgtagggcagtgcccaaaatacgtgaacaggcggtctcttatgctggccacggggatgcgcaacgtgccagagctcatccaggggcgtggattatttggagctattgccggatttctggaaaatggctgggaggggatggttgacggttggtacggtttcaggcaccagaacgcacagggcacaggacaggccgccgactataaaagtacccaggcagcgattgatcagataaccggaaagctgaacaggttggtggaaaaaaccaatactgagttcgagtctatcgagagcgaattctcggaaatcgaacaccagattggaaatgtaatcaactggactatggatagcatcaccgatatctggacctaccaggctgaactgttggtggctatggagaatcaacacacgatcgatatggctgacagcgagatgctcaacctgtatgaacgtgttaggaaacagctaaggcaaaacgctgaagaagacggaaagggatgttttgaaatatatcatgcatgcgatgactcatgtatggagtcaatccggaacaatacatatgaccattctcagtatagggaggaggccctcctgaacagactgaatattaatcccgttaccctatccagcgggtataaggacatcatcctctggttctcttttggtgccagttgtttcgttttgcttgctgttgtgatgggactcgtctttttctgtctgaagaacgggaacatgagatgcaccatttgcatc

SEQ ID NO: 763 - DNA, 1683 bp, Influenza A virus
  misc_feature (1)..(1683): Codon Optimized Sequence Encoding H10 Hemagglutinin
atgtacaaaattgtcgtcatcatagcacttctaggtgccgtgaaaggtttggataagatctgtctaggccatcatgctgtcgcaaacggcactatcgtgaaaactttgactaacgaacaagaggaagtgactaacgctacggagacagtcgaatcgaccgggatcaacagactgtgcatgaaaggccgcaaacacaaagatttggggaactgccatcctataggcatgctgattgggacaccagcttgcgacctccacctgacgggaatgtgggacaccctcattgagcgggagaatgcgatcgcgtactgttacccgggggctaccgtcaatgtggaggcactcaggcaaaagatcatggagtctggcggcatcaataagatttccactgggttcacctatggatctagcattaattctgcaggtacaactagagcttgtatgagaaatggggggaatagtttctacgccgaacttaaatggctggtgagcaagtcaaagggacaaaacttcccccagacaacgaatacttacaggaatacggataccgcagagcacttgatcatgtgggggattcatcatccatcaagcacacaggaaaaaaacgatttgtatgggactcagtcactgtctattagcgtgggatctagtacttacagaaacaacttcgtacctgtggtgggagcccgaccacaggtgaatggacagagtgggaggattgactttcactggaccctggtgcaacctggtgataatattacatttagccacaatggcggattgatcgcaccatcccgagtcagtaagctcataggccggggacttggcatacagagcgacgctcctatcgataacaattgcgagtccaaatgcttctggcggggaggaagtataaacacacggctgccatttcagaacctttcgccccgcacggtcggccagtgccccaaatatgtgaataggcgttcactcatgctcgcaacaggaatgagaaatgtgcctgagctgattcagggcagggggcttttcggtgctatagcgggatttttagagaacggctgggaagggatggttgatgggtggtacgggttccggcaccaaaatgcgcagggaacaggacaggctgccgactacaaatctacccaggctgcaattgatcaaataactggcaaactcaataggttggtggaaaagacgaacaccgagttcgagtcaatcgaatctgaattcagcgagattgaacaccaaatcggaaatgtgattaactggaccaaggactccatcaccgacatctggacctatcaggccgaactgctcgtcgctatggagaaccagcataccatagatatggccgacagcgagatgctcaacctttacgagcgcgtcaggaaacagcttaggcagaatgctgaagaagacgggaagggatgttttgagatctatcacgcttgcgatgattcctgtatggagtccataaggaacaacacctatgaccattcacagtaccgtgaagaggccttgcttaaccgcctcaacataaatcccgttactctcagctcaggttataaggatatcatcctgtggtttagctttggagcctcctgctttgtgctcctcgccgtcgtgatgggcctattctttttttgtctgaaaaacgggaatatgcgatgcactatatgtata

SEQ ID NO: 764 - DNA, 1683 bp, Influenza A virus
  misc_feature (1)..(1683): Codon Optimized Sequence Encoding H10 Hemagglutinin
atgtataagatcgtggtgatcattgcactcctgggagccgtcaagggcctggataaaatatgcctggggcaccacgccgttgccaacggaactatagtaaagaccctgaccaatgaacaggaagaagtgaccaacgcaaccgaaaccgtggagagtacaggcataaatcgcctttgcatgaagggtcgaaagcacaaagacctggggaattgccaccccatagggatgctgatcggcaccccggcttgtgatttgcacttgactgggatgtgggatacactcattgagcgcgaaaacgcaatcgcatattgctaccccggggcaaccgtgaacgtcgaggccctgcggcagaaaattatggagtctggcggaataaataagatttcaaccggttttacatacggaagttctattaatagcgcaggcacaacaagggcgtgtatgaggaacggtggtaatagtttctatgcagaactaaaatggttggtgtctaaatcgaaaggtcaaaatttcccccaaactaccaacacctaccgcaatactgatactgccgaacacttgattatgtggggtattcaccacccatcctcaacacaggaaaagaacgatttgtacgggacacagagtctgagtattagtgtaggctctagcacctacagaaataactttgtcccagtggtgggcgctcggcctcaggtgaatggccaatctggaagaattgacttccattggacacttgtgcagccaggtgataacatcacttttagccataatggtgggctgattgccccttccagggtgagtaaacttattggtcgcgggctggggatacaatcggatgcccctatcgacaataattgcgaatccaagtgtttttggaggggcgggtcaatcaataccaggctacctttccagaatctgagtccacgtaccgtcgggcagtgtcctaagtatgtcaatcgacggtcactgatgctcgctaccggcatgcggaatgtcccagagctgatccaagggcgtggtctgttcggcgcaattgccggcttcctcgagaatggatgggagggcatggtagatggatggtatggttttagacaccaaaacgcccaaggaactgggcaggcggccgattataaatccactcaggccgcaattgatcagattactggcaagctaaaccgtttagttgagaaaacgaacaccgaattcgagagcatagagagtgaatttagtgagatcgagcatcaaattgggaatgtgattaactggaccaaagactcaataaccgatatctggacctaccaggcagagttactggtagctatggagaaccagcataccatcgacatggccgactctgagatgctcaatttgtatgagagggtcaggaaacaactgcggcagaatgctgaagaagatggaaaagggtgctttgaaatatatcacgcatgcgacgatagttgcatggagtccatacgaaacaatacctacgatcactcacagtatagagaggaagccctcttaaataggctaaatataaaccctgtcacactgagctctgggtacaaagatattatcttatggttctcatttggggctagttgtttcgtgctcctggcggtcgtgatgggcctgttcttcttctgtctaaagaacggtaatatgagatgtactatctgcatt

SEQ ID NO: 765 - DNA, 1683 bp, Influenza A virus
  misc_feature (1)..(1683): Codon Optimized Sequence Encoding H10 Hemagglutinin
atgtataaagtggtggttattatagcgttgctgggcgctgttaaaggtttggacaagatctgcttgggacatcatgctgtcgccaacgggacaatcgtcaagaccctgacaaacgaacaggaagaggtcacaaacgcgactgaaaccgtggagagcacaggaattaatcggctctgtatgaaaggccgcaaacacaaagatcttggaaattgccacccaattgggatgctcattggcacaccagcctgtgatctacatctgaccggcacatgggacactctcatcgaacgcgagaacgctatcgcatattgttaccccggggcgaccgtgaatgttgaggccctgcgccagaagattatggagagtggaggcatcgataagatatcgaccggcttcacttacggaagctccattaactccgctggtaccacccgggcctgcatgaggaacggcggcaattccttttacgccgaactgaagtggttagtgtctaaaaataaggggcagaattttccccaaaccacaaacacataccgaaacaccgacacggccgagcatctgatcatgtgggggattcaccatccttcttccatccaggaaaagaacgatctgtacggaactcaatctctctccatctccgttggttcctccacgtataggaacaatttcgtacccgtggtcggcgcccgaccacaagtaaacggccagtccggccgcatcgacttccactggacacttgtgcagccaggagacaacattacattctcccataatggcgggctgattgcacccagccgggtctccaagcttatcggccgcggcctggggatccagtcagacgcgcccatcgataacaactgcgaaagcaagtgtttttggcggggtggatctattaacacccgtctgcctttccagaatcttagtccccggacagtggggcagtgccccaagtatgtgaatcgaaggtctctgatgctggccacaggcatgagaaatgtgccagagttgattcagggccggggtctctttggagccattgccggttttcttgaaaacggttgggagggtatggtcgacggttggtacggtttccggcaccagaacgcacagggcactggtcaggctgcagattataaatctacacaagccgctatcgaccagatcacgggcaaactaaatagactggtcgagaagactaacactgaatttgagagcattgagtcggagttttccgagattgaacaccagatcggaaatgtgattaattggacaatggactcaattactgacatctggacataccaagccgaactgctggttgcgatggagaaccagcacaccatcgatatggccgatagcgaaatgctaaatctgtatgagagggtaaggaagcagctgcgccagaatgccgaagaagacgggaagggttgttttgagatctaccatgcttgtgacgacagttgcatggaaagcattcgaaacaacacttatgaccactcgcaatatcgcgaagaggcccttttgaatcggctcaacataaacccagtgacactttcttccggttacaaggatattatcctgtggttctcttttggagcatcgtgttttgtactgctcgctgtcgttatgggcttggtcttcttttgtctgaaaaatggcaatatgcggtgtaccatctgcatt

SEQ ID NO: 766 - DNA, 1683 bp, Influenza A virus
  misc_feature (1)..(1683): Codon Optimized Sequence Encoding H10 Hemagglutinin
atgtataagattgtggtgatcattgcactgctgggggctgtgaagggactcgacaagatttgcctgggccaccatgccgttgcaaacgggaccatcgtcaaaacattgacaaacgagcaggaagaggtgacaaacgccactgaaacagtcgaaagtacggggattaaccggctatgtatgaaggggaggaaacataaagatctaggcaactgccaccccataggcatgcttatcggcaccccggcctgcgaccttcacctgaccggaatgtgggataccttgatcgagagggaaaacgccatcgcttattgctacccaggagccacggtgaacgtagaggctctacgacaaaagattatggagagcggcggaataaataaaatatccacgggattcacctacggttcctcgataaattcagcgggcaccaccagagcctgcatgcgcaacggcggcaattccttttatgccgagcttaagtggctcgtttccaaaagcaaggggcagaactttcctcagaccacaaacacctataggaataccgacaccgcggagcacctgattatgtgggggatccaccatccctcaagtacacaggaaaagaacgatctctatggaacccagagcctgagtatcagcgtggggtccagcacatatcgcaacaactttgtcccagtggtcggagcccgcccacaggttaacggccaatccggtcgcattgactttcactggaccttggtgcaaccaggggataatattaccttcagccacaatggtggactgattgccccaagtcgtgtttccaagctgatcggaagagggttaggtatccagagtgacgccccaattgataataactgcgagagcaaatgcttctggcgggggggatcgattaatacgcgtctcccctttcagaacctctccccacgtacggtcgggcagtgtccaaagtatgtgaacagacgttcactgatgctggcaacagggatgagaaacgtacccgagctgatccaggggagagggctgttcggtgccattgccggatttctcgaaaatggttgggagggaatggtggacggttggtacggattccggcaccagaacgctcaggggaccggccaagcagctgattataaatctacccaggccgccattgatcagatcaccgggaagttgaaccgcctcgtggagaagactaacacagagttcgagtctatcgaatcagagttcagcgagattgaacaccagattgggaacgtgattaactggaccaaggactccatcaccgacatttggacatatcaagccgagctgctggtagccatggagaaccagcacaccatagatatggcagatagtgagatgctgaacctctatgaacgcgtgcgaaagcaactgcgacaaaatgctgaggaggatgggaagggatgctttgaaatctaccacgcgtgcgacgattcttgtatggaaagtatccggaataatacttatgatcactctcagtatagggaggaggcactactaaatcgtctgaatatcaacccagtgaccttatcctccggatacaaggacattatcctgtggttcagttttggcgcttcctgtttcgtgctcctggctgtagtgatgggcttatttttcttctgcctgaaaaacggaaatatgcggtgcaccatttgcatt

SEQ ID NO: 767 - DNA, 1683 bp, Influenza A virus
  misc_feature (1)..(1683): Codon Optimized Sequence Encoding H10 Hemagglutinin
atgtataagatagtcgtaattatcgcactcctcggggctgttaagggcctggacaaaatctgtctgggtcaccatgcagtcgccaacggaacaatagtcaagactctgaccaatgaacaggaggaggttacgaatgccacggaaaccgtggaaagtacagggatcaaccgcctgtgtatgaaagggagaaagcataaagacttgggtaattgccatccaatcgggatgctgattggaacacccgcttgtgacctccatttgaccggtatgtgggacacactgatcgaaagagagaatgccatcgcgtattgttaccctggtgccactgtgaacgtggaggcactgcgccagaagatcatggaatccggcggaatcaataagatctccaccggatttacctacggatccagtataaattcagccgggacgacaagagcatgcatgagaaacggcggcaacagtttttacgccgagctgaagtggcttgtgtccaagtctaaaggccagaactttcctcagacaaccaacacctaccgtaacactgatacagcagagcatctgatcatgtggggcattcaccatccatcttccacccaagaaaagaatgatctgtacggaacacagagcctgtctattagtgttggatcgtcaacctaccggaataactttgttcccgtagtgggcgcacgcccccaggtgaatgggcagtcaggtcgaattgattttcactggaccctcgtgcagcctggcgacaatattacattcagtcataacgggggactgatcgccccaagccgcgtttctaagctgattgggagaggtttgggaattcagagcgacgcacctatcgataacaattgcgaatcaaagtgcttttggcgggggggcagcataaataccagactgccctttcagaaccttagccctaggacagtcgggcagtgtcccaaatacgtcaaccgccggagtctgatgctcgctacaggaatgagaaatgttccagagctaatccagggacgaggactcttcggagccatcgctggatttctggagaatggctgggaggggatggttgatgggtggtatggctttagacatcagaacgcccaggggacaggtcaggccgccgattacaagtctacccaggccgcgattgaccagatcactggcaaattgaataggctggttgagaaaactaacactgaatttgagtcaatcgagagcgagttttctgagatcgaacaccagatcgggaacgtgattaattggactaaagactctataacggacatttggacctatcaagccgagttattagtcgcgatggagaaccagcacacaatagatatggcagactctgagatgctgaacctgtacgagagggtgcggaagcaattaaggcagaatgccgaagaggatgggaagggatgcttcgaaatataccatgcctgcgacgactcgtgcatggagagcattagaaacaatacatacgaccatagccagtatcgcgaggaagcactactgaatcggctgaatatcaatccagtcacactctcttctgggtacaaagatatcattctgtggtttagcttcggcgcctcctgcttcgtccttctggccgtggttatggggctgttttttttctgtcttaagaacggaaatatgaggtgtaccatctgtatt

SEQ ID NO: 768 - DNA, 1683 bp, Influenza A virus
  misc_feature (1)..(1683): Codon Optimized Sequence Encoding H10 Hemagglutinin
atgtataagattgtggtgatcattgccctcctaggcgccgtaaaagggttagataaaatctgcctgggacaccacgccgtggccaacggcactatagtcaagaccctcactaacgagcaggaaaaagtgaccaatgctacggaaacagtggaatctacaggcctgaatcgcctttgcatgaaaggcaggaaacacaaagacttagggaattgtcaccccattggaatgttaattgggactccagcttgcgatctgcacctcactggtacatgggatacaattattgaacgggagaatgccatcgcatactgctaccctggggcgaccgtcaatgaggaagctctgcggcagaagatcatggagtctggtggcattgataaaatctccaccgggttcacgtatgggtcttcaattaatagcgctggaacgactagagcttgtatgcgcaatggtggaaattccttttacgctgagcttaaatggctcgtctcgaaatccaagggacagaactttccgcaaactacaaacacttatagaaacacagacaccgcagaacacctcatcatgtgggggattcaccacccttctagtacccaagaaaagaatgacctctatggcacacagagcctgtccatctcggtcggcagcagcacctaccggaacaactttgtgcccgtggtgggcgcgcgcccccaagttaacggacagtccggtcggatagatttccactggacactggtccagcccggggataacataacgttctctcacaacggagggctgatagctccttctcgagtgtcaaaattgattggaaggggcttggggatccagtccgatgccccaatagacaataactgcgagtctaaatgtttttggaggggcggttctataaatacccgtctgccttttcagaatcttagccccagaacagtgggacagtgtcccaagtacgtaaataaaagaagtctgatgcttgcaaccggcatgaggaatgtccctgagctgatccagggtcgtggcttgttcggtgccattgcgggcttcttggaaaatggttgggagggaatggtagacggatggtatgggttccgccaccaaaatgctcaggggacgggccaagctgccgactataagagtacgcaagccgctattgaccagatcactggcaaattgaacagacttgttgaaaaaacaaatacagaattcgaaagcatcgaatcagaatttagcgagattgagcaccaaatcggcaacgtgatcaattggacaaaagactccataaccgatatttggacctaccaggccgagctgctcgtggctatggagaaccagcacaccatcgacatggctgatagcgagatgctgaatctatatgaaagggttcggaagcagttgcgtcagaatgcggaggaggatgggaagggttgctttgaaatctatcacgcctgcgatgacagctgtatggagagcatacgaaataatacctatgaccattcacagtaccgcgaggaggccctgctcaatcggctgaacatcaatccggtgacactgagctctggctacaaggacatcattctgtggttctcattcggggcgagctgctttgttttgttagccgtcgtgatgggcctcgttttcttctgcctgaagaatgggaatatgcgctgtacaatctgcatc

SEQ ID NO: 769 - DNA, 1683 bp, Influenza A virus
  misc_feature (1)..(1683): Codon Optimized Sequence Encoding H10 Hemagglutinin
atgtacaagattgtcgtgattatcgctttgctcggcgccgtgaagggactggataaaatctgtctggggcatcacgctgtggctaatggaacaattgtgaagaccctcaccaatgagcaggaggaagtgacaaacgctacagagacagtcgagtccaccggaatcaacaggctgtgcatgaagggccggaaacataaggacctcgggaactgccaccctattgggatgctgataggcacacctgcctgtgacttacaccttaccgggatgtgggatacactgatagaacgggagaatgccatagcatactgctacccaggagctacggtgaatgtggaagctctccgccagaaaattatggaatcaggcgggattaataagatttctacgggcttcacttatggaagttcaataaattcagccggaacaacccgggcttgtatgagaaatggtggaaattctttctacgcagaactcaagtggcttgttagcaagtccaagggccaaaacttccctcagaccactaatacttacaggaatactgacaccgccgaacaccttatcatgtggggtatccaccatccatctagcacccaggagaaaaatgatctttacggtacccaatcactgagcatcagcgtggggagctcaacttatcgcaacaatttcgtgcctgtggtgggtgcccgaccacaggttaacggacaaagtggacgaattgactttcattggaccctggtgcagcctggcgacaacatcacattctcgcataatggaggtttgatcgctccctcccgtgtgtctaagctgatagggagaggcctcggtatacagtccgacgctcccatcgataataattgtgaaagcaagtgcttttggcgaggtggcagcattaacacgcggttaccctttcagaacctcagcccacgcacagtcggccaatgccctaagtatgtaaaccgccggagcttgatgctggcaacgggcatgagaaacgtccccgagctaatccagggcagaggactgttcggcgccattgctggctttcttgagaacggatgggagggaatggtggacggctggtacggattccggcaccagaacgcccagggcaccggccaggccgccgattataagtccacccaagctgccatcgaccagatcaccggcaaactgaatcggcttgtagagaaaaccaacaccgaattcgagtcaatcgagtccgaatttagcgagatcgaacaccagatcggcaatgtgattaactggacaaaggacagtatcactgatatctggacctaccaagcagaattactggtcgctatggaaaatcagcacaccattgatatggccgacagcgagatgctcaacctatatgaacgcgtccgcaagcagctgcgtcagaacgcagaggaagatggaaaaggctgcttcgagatctaccatgcttgcgatgactcttgtatggagtccatccgcaataacacatacgaccactcccagtacagggaggaggcgcttttgaacagactgaatataaatcctgttactctttcatcggggtataaagacatcatcctgtggttctccttcggcgcctcctgtttcgtcctgctggcggtagttatgggcctattttttttttgtctgaagaatgggaacatgcgctgtacaatttgtatc

SEQ ID NO: 770 - DNA, 1683 bp, Influenza A virus
  misc_feature (1)..(1683): Codon Optimized Sequence Encoding H10 Hemagglutinin
atgtacaaaattgttgtcatcattgctctgctgggggctgtgaaaggactggacaaaatctgcttaggccatcacgctgtagccaatggtaccattgtgaagacactgaccaatgaacaggaaaaagtaacaaatgctaccgagacggtcgagtccacagggctgaaccgattgtgcatgaagggacgcaagcacaaggatctgggaaattgccacccgattggtatgctgattgggactccagcctgcgatctgcatctgaccgggacttgggatactatcatagaacgggagaacgccatcgcctactgctacccaggtgccactgtaaacgaggaagccttgcgccagaaaattatggagtcaggtgggattgacaagatttccactgggttcacttatgggagcagtattaactcagctggcacaacccgtgcttgtatgcggaacggaggaaactcattctacgcagagctgaaatggctggttagcaaaagcaagggccagaatttcccacagacaaccaatacatatcggaacactgataccgcagagcacctgattatgtggggcattcaccacccatcctccacgcaagagaagaatgatctgtatggaactcagagcctgtcaatctccgtgggatctagcacatatagaaataattttgtgcctgtggtcggcgcgcgaccacaggttaatggacaatcaggacgcattgatttccactggaccttggttcagcccggggacaatataacattcagccacaacggtggcctgatcgccccctcgcgggtgagtaagctgattggcagaggactcggtattcagagcgatgcccctattgataataactgcgaaagcaaatgtttttggagaggcgggtcgatcaacaccagattaccctttcagaatctctctcctagaaccgttggtcagtgcccgaaatatgtcaacaagcgtagtttgatgctagccactggaatgcgcaacgtaccagaactcatccagggaaggggtttgttcggagcgattgcaggtttcctggaaaatgggtgggagggaatggtggacgggtggtatgggtttcgccatcagaacgcacagggaacaggtcaggcagccgactataagtctacacaagccgccatagatcagatcacgggaaagctaaaccgcttggtggagaagacaaataccgagttcgagtctatagagagtgagttttccgagatagaacatcaaatcggtaatgtgatcaactggactaaagactcgataacagacatctggacctaccaggcggaactgctcgtcgccatggagaaccagcacactatcgatatggctgattcagaaatgctgaacctgtatgaacgcgtacggaaacagctgcgccagaatgcagaggaggatgggaaaggctgttttgaaatctaccacgcctgcgacgatagctgcatggaaagcatccgcaataacacatatgaccactctcagtatcgcgaggaagctcttctgaaccgtctcaacatcaatccagtgacgttgtcatctggatacaaagacatcatattatggttttccttcggcgcaagttgcttcgtgctcctggcagttgtcatgggcctggtcttcttctgtctcaagaatgggaatatgagatgcacgatctgtatc

SEQ ID NO: 771 - DNA, 1683 bp, Influenza A virus
  misc_feature (1)..(1683): Codon Optimized Sequence Encoding H10 Hemagglutinin
atgtacaagattgttgtgatcatcgctctgctcggtgccgtcaaagggttggataagatttgcctcggccaccatgcagtagccaacggcacaattgtgaaaactctcaccaacgagcaggaagaggtcaccaatgccaccgaaacagtcgagtcaactggcattaatcgattatgtatgaaaggaagaaagcataaagacttgggaaactgtcatcctatcgggatgctcatcggaacaccagcatgtgacctccatttaaccggaatgtgggacacattaatcgagcgtgagaacgcaattgcctattgctaccctggcgcaacagttaacgtcgaagctttgagacagaagattatggagtcaggaggcatcaataaaatctcgaccgggtttacctacggctcctccatcaactcggctggcacaaccagagcctgcatgcgtaacggaggcaatagtttctacgctgagcttaagtggctggtaagtaaatcaaaaggtcaaaatttcccacagactacgaatacttacagaaatacagacacagccgaacaccttatcatgtgggggatccaccaccctagcagtactcaggaaaaaaacgatctgtacggcacccagagcctgtcgatctctgtgggaagttcaacttaccgaaataatttcgtccctgtcgttggtgcaaggcctcaggtcaatggccagtcaggacgcatcgatttccattggactctggtgcaaccgggcgacaacattaccttttcacataatggcggccttatcgccccctcccgagtgagtaagctgatcggtcggggattgggaatccagtctgatgcacccattgataataactgtgaatctaaatgtttctggagaggaggttccattaatacacggctgccctttcagaacctgtcccctcgaaccgtcggacagtgccccaagtacgtgaacaggagaagtctcatgctggcgacagggatgagaaacgttcccgaactgattcagggacggggcttattcggggctattgcaggctttctggaaaacggctgggaggggatggtggacggctggtacggattcaggcatcagaacgcacagggcaccggccaagcagccgactacaagagcactcaggcagccatcgaccagattacaggaaaacttaataggcttgtggagaaaaccaataccgaattcgagtcaattgaatccgagtttagcgagatcgaacatcaaatcggcaacgtgattaactggacaaaggactccatcacggacatatggacttaccaggccgaactgttggtggccatggaaaatcaacatacaattgatatggcagacagtgagatgctgaacctgtacgagagggtcagaaagcagctacgtcagaacgctgaagaggacgggaagggctgtttcgaaatttatcacgcctgtgacgactcctgcatggaatctatccgcaataatacttatgaccacagtcagtatcgcgaagaggccctcttaaacagattaaacatcaatccggtgactcttagcagtggctacaaggacattattttatggttttcgttcggagctagctgtttcgtcctcctcgccgtggtgatgggtctgttcttcttttgcctcaagaatggaaatatgagatgtacaatctgtata

SEQ ID NO: 772 - DNA, 1683 bp, Influenza A virus
  misc_feature (1)..(1683): Codon Optimized Sequence Encoding H10 Hemagglutinin
atgtataagatagtcgtgatcattgcgcttctgggagcagtaaagggtcttgacaagatttgtctgggccaccatgctgtggccaacgggactattgttaagactctgactaatgaacaggaagaagttacaaacgctactgagacggtggagagcactggcataaatagattgtgtatgaaagggaggaaacacaaagacttgggtaattgccacccgattgggatgctaattgggactcccgcttgtgacctgcaccttactggcatgtgggataccctaatagaacgtgagaacgccattgcctattgttacccaggcgctactgtcaatgtggaggcacttaggcagaagatcatggaaagcggcggcatcaacaagatctccaccggatttacctatggttcaagtatcaacagtgccggtaccacccgcgcttgtatgcgcaacggaggaaacagtttttatgctgagctcaaatggctagtaagtaagtctaagggacaaaatttccctcagaccaccaacacttatcgtaacacagacaccgcagagcatctcattatgtgggggatacaccatcccagcagcacacaggagaagaacgatctgtatggcacccaatcgctctccatctcagtgggttcttctacctatagaaataacttcgtgcctgtcgtgggcgcacggccacaggtgaacgggcagagtggcagaatcgattttcattggacgctggtccagcccggcgataacattaccttctcacacaatgggggattgatcgccccttctagggtatcaaaattgatcggcaggggacttgggatccaaagcgatgcccctattgacaacaactgcgaatcgaaatgcttctggcggggcggcagcattaatacacggctgcccttccaaaatttatccccaagaacagttggccagtgccctaaatacgtcaaccgtcgcagccttatgttagccacaggaatgcggaacgtcccggagcttattcagggcaggggcctgttcggcgcaatcgcgggctttctggaaaatggttgggaagggatggttgacggctggtacgggttcaggcaccagaatgcccagggaacaggtcaggccgctgactataagtcaacacaagcagccatcgaccaaattaccggcaagctgaatagacttgtggaaaaaacgaatacagaattcgagagtattgaaagtgaatttagtgagattgaacaccaaattggcaatgtcattaactggacgaaagattcaatcaccgacatctggacctatcaggctgaactcttggtcgcaatggaaaaccaacataccatcgacatggctgattctgagatgctcaacttatacgagcgagttcgaaagcaactgcggcagaatgccgaggaggatgggaaggggtgtttcgaaatttatcatgcctgcgacgacagttgtatggagagcatccgtaataatacttatgaccatagtcaatacagagaggaggctcttctgaacaggctgaacatcaaccctgtgaccttaagctccggatacaaggacattatcttgtggttcagttttggagcctcatgtttcgttctgttggcagttgtgatgggcctcttcttcttctgcctgaaaaacggaaacatgcgttgcactatatgcatc

SEQ ID NO: 773 - DNA, 1683 bp, Influenza A virus
  misc_feature (1)..(1683): Codon Optimized Sequence Encoding H10 Hemagglutinin
atgtacaagattgtggtcatcattgccctgcttggggccgtcaagggcctggacaaaatttgcttggggcaccatgccgtggttaatggcaccatcgtcaaaacccttacgaacgaacaagaagaggtcaccaacgccactgagacagttgaaagtacaggcctcaatcgattgtgcatgaaaggtaggaatcacaaagatctggggaactgtcaccccatagggatgctgattggcacaccagcctgtgatctgcatttgacagggacctgggatactctaattgagagagagaacgctattgcctactgctaccccggcgccacagttaacgaagaggctctgcggcagaaaataatggaatccggtggtattaacaagattagtacagggtttacatacggatcgtctattaattcagctggtacaactcgggcttgcatgaggaacggtggcaactcattctatgcagaactgaagtggttggtaagtaagtcgaaaggtcaaaattttccccagacaacaaatacatatcgcaataccgacaccgcggaacatttgatcatgtggggcatccaccatccatcaagtacacaggagaagaatgacctttacggtactcagagtctgagcatttcagttggatccagtacataccaaaataacttcgttcctgtcgtcggagcccgcccgcaggtaaatggtcagtccgggcgcattgactttcattggaccctcgtgcagcccggcgataacataaccttctcacacaatggaggactgatcgcacccagcagagtgagcaaacttatcgggagaggtctggggatccaaagtgacgcccccattgataacaactgtgagtccaaatgtttctggcgagggggttcaattaacacccgcttgcctttccaaaacctgagccctcggacggtgggccagtgtccaaagtatgtgaataaacggtctctgatgttagctactggcatgagaaacgttcctgagttgatgcagggaaggggtctcttcggcgcaatcgctggctttattgagaacgggtgggagggaatggtggacggctggtatggttttaggcatcagaatgcccagggcaccggacaggcggctgattataaatcaactcaagccgccatcgaccaaatcaccgggaaactaaaccgtctgatcgaaaaaaccaatactgagttcgagtctatcgagagcgagtttagtgaaatcgaacaccagattggaaacgtgatcaattggacaaaagatagcattaccgatatttggacctaccaggccgaattgctggtggcgatggaaaatcagcacacaatcgacatggcagactcggagatgttgaatctgtatgagagagtgaggaagcagctgcgccagaatgccgaagaggatggaaagggatgcttcgagatctaccatgcatgtgacgactcctgtatggaaagcatcagaaataatacatacgatcactctcaatatcgagaggaggcgcttcttaatcgtttaaatatcaatcccgtcacactgtcctctggttataaggacataattttgtggttctcgttcggtgccagttgtttcgtcctgctagcggtcgtgatgggcctggtgtttttttgccttaaaaacgggaacatgcggtgcaccatctgcatc

SEQ ID NO: 774 - DNA, 1683 bp, Influenza A virus
  misc_feature (1)..(1683): Codon Optimized Sequence Encoding H10 Hemagglutinin
atgtacaagattgtcgtcattatcgcgctgttgggggccgtcaagggactggataagatttgtctgggccatcacgccgtggccaacggcacaatcgtcaagactctgaccaacgaacaggaagaggtcaccaacgccacagaaaccgtggagagtacgggtattaaccgcctctgcatgaagggtcggaagcataaggacctcggtaactgtcatccaatcggcatgttgattggcacacccgcctgcgacctgcacctgactggcatgtgggacacactgattgaaagggaaaacgcaatcgcgtactgttacccaggtgcaacggtgaacgttgaagcactgaggcagaagatcatggagagcgggggcatcaacaaaattagcacgggcttcacatacggtagcagtatcaacagcgctggcaccacacgggcctgcatgcggaatggagggaacagtttctacgctgaactgaagtggttagtgagcaaatctaagggtcagaatttcccccaaaccactaatacctaccgcaacactgacaccgccgagcacttaataatgtggggcatccatcatccttcaagcacgcaggagaagaacgacctgtacggcacccagtctctgagtatctcggtgggttcgtccacctatagaaacaattttgtgccagtggtgggggccaggccacaggtcaatggacaatcgggacgtatcgactttcattggaccctcgtgcagcctggtgataacattacattcagccataatgggggcctcatcgcccccagtagggtctccaagctcattgggagaggactcggaatccagagtgatgcacctattgacaacaactgtgagagcaaatgtttttggagaggcgggtctattaacactcgattgcctttccaaaatctctcacctaggaccgtcggtcagtgtcctaagtacgtgaataggagaagcctcatgctcgcgacaggcatgagaaacgtgcccgaactgatccagggcaggggactcttcggggctatcgcaggattcttagagaatgggtgggaaggaatggtggatggatggtatggctttaggcatcagaacgctcagggcactggccaagctgcggactacaagagcactcaggccgcaatagaccagattaccggcaagttgaatcgcctagttgaaaagactaatacagagtttgagagcattgaaagcgagtttagcgaaattgaacatcagatcggcaatgttataaactggacaaaggactccataactgatatatggacttaccaggcagagctactagtcgccatggagaaccagcatactatcgacatggccgactcagagatgctgaacctatacgaaagagttcggaagcagttaagacaaaacgccgaggaggacggaaagggttgcttcgaaatctaccacgcatgtgacgactcatgcatggaatctatcaggaataacacatacgatcattcacagtatagggaggaggctttgctgaatcgcctcaatatcaatcccgtcactttatctagcggctacaaggacattatcttgtggttcagttttggtgcctcttgctttgtgctcctggcagtggtgatgggactcttttttttctgtttgaagaacggtaatatgcgttgtacaatttgcatc

SEQ ID NO: 775 - DNA, 1683 bp, Influenza A virus
  misc_feature (1)..(1683): Codon Optimized Sequence Encoding H10 Hemagglutinin
atgtacaagattgtggtgatcatcgcactgctgggtgctgtgaaaggcctggacaaaatatgtttgggtcaccacgccgtggcaaatggcaccatagtcaaaaccctcaccaacgaacaagaggaagtgacgaatgcgactgaaacagtggagtcgaccggcatcaaccgtctgtgtatgaaaggcagaaaacataaggatctcggcaattgccatcccattggaatgttaatagggacgcctgcgtgcgatttgcatctgactgggatgtgggataccctaatagagcgggagaacgccatagcctattgctacccaggagctaccgtcaatgtggaagccctacggcagaaaattatggaaagcggtggtatcaataagatttccaccggatttacatacgggtcctccatcaattcagccgggacgactcgtgcttgcatgcgcaacggaggtaactcgttctatgccgaactcaaatggctggtgagcaagtctaagggacagaattttccacaaacaaccaacacctaccgtaataccgataccgctgaacaccttatcatgtggggcattcaccacccttccagcacacaggagaaaaacgacttgtacggcacacagtccctcagtatttccgttggtagctctacttacagaaacaattttgttcccgtcgtcggtgcccgtcctcaagtcaacggacagtccggcagaattgactttcattggacgttagtgcagcctggggacaacattaccttcagccacaatgggggtctgattgcgccgtcccgcgttagcaagctgataggccgagggctgggcattcagagcgatgcacccatcgacaataattgcgaatccaaatgcttttggcggggtgggagtattaatactcgcctcccctttcaaaatctctcaccacgcactgttgggcagtgtcccaaatacgtgaatcggcgtagcttaatgctggctacagggatgaggaacgtgcccgaactgattcaaggccgtggtctttttggagccattgccggctttttagagaatggctgggagggcatggttgacggttggtatgggtttaggcaccagaacgcccagggcactggacaggcagccgattataagtccacacaggccgctattgatcagattactggaaaattgaatagactcgtggagaaaactaacaccgagttcgagtctattgagtcagaattttctgagattgagcaccagatcggtaatgttatcaattggacaaaggacagcatcactgacatttggacgtaccaggccgagctgctggtggcaatggagaaccagcacaccatcgacatggcggactcagagatgctgaacctatatgaaagggtgcgtaaacagcttaggcaaaatgctgaggaggacggcaaaggatgtttcgagatttatcatgcctgcgatgactcctgcatggaatcaattcgcaataatacttatgaccattcacagtatcgcgaagaagcgcttctgaatcggctaaatattaaccccgtaactctgtcttctggatacaaggatattatcctgtggtttagttttggagcttcatgtttcgtattgttggccgtggtgatggggctgttctttttctgtcttaagaacggcaacatgaggtgtacaatttgcatt

SEQ ID NO: 776 - DNA, 1683 bp, Influenza A virus
  misc_feature (1)..(1683): Codon Optimized Sequence Encoding H10 Hemagglutinin
atgtacaagatcgtcgtgatcattgccctgctcggggccgtgaagggccttgacaagatttgtctaggccaccatgcagttgctaacggaactattgtcaagacattgaccaacgaacaggaggaagtgacaaatgccacagagacagttgagtctactgggataaacagattgtgtatgaaaggcaggaaacacaaagatctcggaaattgtcatcctatcggaatgctgataggaactcccgcttgcgatttgcatttgacaggaatgtgggacacactgatcgaacgagaaaacgccatcgcgtactgctaccccggtgccactgtgaacgtggaggcccttcggcaaaagatcatggaatcaggaggaatcaataagatctctaccgggttcacttatggcagctctatcaactccgccggtactactagggcctgcatgagaaatgggggaaatagcttctacgcagaactgaagtggctggtgagcaagtcgaaggggcagaacttccctcagactacgaatacctatcgcaataccgatactgctgagcatttgattatgtggggcatccatcatccgtcgtcgacgcaagagaaaaatgacctttatggcacacagtccttgtctatttctgtagggtcttctacctatcgcaataactttgtgcctgttgtcggcgccaggccacaggtaaatggacagtctggcagaattgatttccactggacgctcgtacagcctggggataatattacattctcacacaacggcggacttatcgccccgagccgtgtctcaaagctgattggaaggggactcggcattcagtccgatgcgcccattgacaacaattgcgagagcaagtgtttttggcgcggtggatccatcaatacccgccttccttttcagaatttatcaccacgtaccgtcggccagtgtcccaaatatgtgaatcgaagatctctgatgctggccacaggcatgcggaacgtccctgagctgatccagggaagggggcttttcggagcgattgccgggtttctggaaaatggatgggaaggaatggtggacggctggtacggcttcagacatcagaatgcccagggaaccgggcaggctgcggattacaaatctacccaagctgctatcgaccagatcacaggtaagctgaatcggctcgtggagaaaactaacactgaatttgagtccatagaaagcgaatttagtgaaatcgaacaccaaatcggaaatgtgattaactggacaaaagatagcattaccgatatctggacctaccaagctgaattgctggtcgccatggagaaccaacacactattgacatggcagactccgaaatgctaaatttgtacgagcgcgtccgcaaacagttgcggcaaaacgcagaagaagatggaaagggctgctttgagatctaccacgcctgtgacgattcctgcatggaatcgatacgaaacaatacttatgaccatagccagtatcgtgaagaagctctgctaaatcgcctcaacattaaccctgtgacattgagcagtgggtacaaggatattattctctggttttctttcggtgcctcgtgctttgttctgctggcggtggtgatgggactcttcttcttctgcctcaaaaatgggaatatgcggtgtacaatctgtatc

SEQ ID NO: 777 - DNA, 1683 bp, Influenza A virus
  misc_feature (1)..(1683): Codon Optimized Sequence Encoding H10 Hemagglutinin
atgtacaagatcgtcgttatcattgccctgctgggagcagtaaaaggactggacaaaatttgcttaggccatcacgcggtggcaaatgggaccatcgtaaagacactgaccaacgagcaggaggaggtgacaaacgctacagaaacagtagaatcgaccgggatcaacaggctctgtatgaagggccggaaacataaggatctggggaattgccatcctatcggaatgctcattggtacgcctgcttgtgacctccacctcactggaatgtgggacacactcatcgagcgcgagaacgcaatagcatattgttatccgggcgcaactgtcaacgttgaggcactgaggcagaagattatggagagtgggggcatcaacaagatatcaacaggctttacatatggatcgagcatcaattcagcagggacgacccgggcgtgcatgaggaatggagggaatagcttttacgccgaattgaaatggctcgtgtctaagagcaaaggccaaaattttccacagacaactaatacctatcgcaacaccgatacggccgaacatctaatcatgtggggaattcaccacccaagttcgacccaggaaaagaacgatctctacggcacccagagtctgagcatctcggtgggatcctcgacgtaccggaacaatttcgtgcctgtcgtgggagcgcgaccgcaggttaatgggcaatccgggaggatcgattttcactggacgctagtccaacccggggacaacatcactttcagccacaacggtggacttattgctccttcccgagtcagtaaactcatcggccggggacttgggattcaaagcgatgcaccaatagataataactgtgagtctaagtgcttctggcggggaggtagtattaacacacgactcccatttcagaacctgtccccaaggaccgtgggtcagtgccctaagtacgtgaacagacgaagcctgatgttggcaaccggaatgagaaacgtccccgagctgatccaggggaggggactgtttggggcaatagcgggatttctggagaacggatgggaagggatggttgacggatggtacgggtttaggcaccagaacgcccaagggactggacaggctgcagattataaaagtacacaagcggccatcgatcagatcaccggtaaactgaatagacttgtcgagaaaaccaatacagagttcgagtcgatagaatcggaattcagcgagatcgaacaccagatcggcaatgtgatcaattggactaaagacagcatcaccgatatctggacctatcaagctgagctcctagtagctatggagaatcaacacacaatagacatggctgactcggaaatgttgaacctgtatgaacgtgtccgcaagcagctgaggcagaacgccgaggaggacggtaagggatgcttcgagatctaccatgcttgtgacgattcttgtatggaaagtatcagaaacaacacctacgaccatagccagtacagggaagaggccctgctgaatagactgaatatcaacccagtgaccctcagctctgggtataaagatatcattctgtggttctcattcggtgcatcgtgcttcgtactgctggccgttgtcatgggactctttttcttttgtcttaaaaatggcaatatgcgatgcacaatttgcatt

SEQ ID NO: 778 - DNA, 1683 bp, Influenza A virus
  misc_feature (1)..(1683): Codon Optimized Sequence Encoding H10 Hemagglutinin
atgtataaaatagttgtcatcatcgccctcctaggtgcagttaaggggctcgacaaaatttgtttaggccaccacgccgtggcaaacggcaccatcgtcaagacccttactaatgaacaagaggaggtgactaatgctacagagaccgtggagtctaccggcataaatcgactatgtatgaaaggccgaaagcacaaagatttggggaactgtcatcctatcggaatgctgattggaaccccagcctgcgatctgcacctcaccggcatgtgggataccctgatcgaacgtgaaaatgctatcgcatactgttaccctggagccacagtcaacgttgaggcattgaggcaaaagatcatggagagcggtggaatcaataagatctcaacagggtttacctacggcagctctataaactccgctggcacaacaagagcctgtatgcgcaatgggggaaattccttttatgccgaactgaaatggcttgtatcaaagagcaagggccagaacttcccccaaacgactaatacttatcgcaacacagatacagctgagcacctgataatgtggggtatccaccatccatcatcaacgcaagaaaagaacgatctgtacgggactcaaagcctgtctatctccgtcggcagcagcacatataggaataactttgtgcccgtcgtcggcgctagaccgcaggttaacggacagagtggccggatagacttccactggactctggtccagcctggcgataacatcaccttcagccacaatggcggtttgatagcaccctctcgtgtgtctaagctgatcggaagaggcctcgggattcagtccgacgccccgatcgacaataactgcgagagtaaatgtttttggagaggaggatccattaacacccggctgccgttccagaatttgagccctaggacagtggggcagtgtcccaaatatgtcaaccgccgaagtctgatgctagcgactggcatgaggaacgttcccgagctcatccagggacgcgggctgtttggcgccattgccggttttctggaaaacggatgggaaggtatggtagatggctggtatggatttcgccaccagaacgcgcagggcactgggcaggcggcggattacaagtccacacaggcagcgattgatcagatcaccggcaaactgaatcgcctggtggagaaaacaaatacagagtttgagtccatcgaaagcgagtttagcgaaattgagcatcaaattggcaacgtcattaattggacaaaagacagcattaccgatatctggacataccaggcggagctactggtcgcaatggagaaccagcataccatcgatatggccgacagtgaaatgctgaacctctatgagagagtgcgaaagcagttaagacagaatgcggaagaggatgggaaaggttgttttgagatctatcacgcctgtgacgactcttgcatggaaagcattcgaaataatacctacgaccatagtcagtatcgagaagaggctctgttaaaccgattaaatattaacccggtaactttgtcgagtgggtacaaggatattatcctttggttttccttcggggcatcctgttttgtgttgctggctgtggtaatgggactgttctttttttgcttaaagaacggtaatatgagatgcacaatctgtata

SEQ ID NO: 779 - DNA, 1683 bp, Influenza A virus
  misc_feature (1)..(1683): Codon Optimized Sequence Encoding H10 Hemagglutinin
atgtataaagtagttgtgatcatcgctttactgggcgcagtcaaaggtttggacaagatttgtctgggtcaccatgccgttgccaatgggaccatagttaaaaccttaacaaatgagcaggaagaggtcacaaacgctacagagactgtggagtccactgggataaacagactgtgtatgaaaggacgcaagcacaaggacctcggaaattgtcacccaattggaatgctgattggcactcctgcctgcgatttacatctaaccggcacatgggacaccctgatcgagcgggagaacgcgatcgcctactgctaccccggagccaccgtcaacgtagaggcattacggcagaagatcatggagagtggaggcatagataagatctccaccggattcacctatggttctagcattaactccgcaggtacaacaagagcttgcatgcgaaatggagggaatagcttttacgctgagctcaaatggcttgtgagcaaaaacaagggacagaattttccccagaccactaatacttatagaaacactgacaccgctgagcacttaatcatgtggggaatccaccacccctccagtatccaagaaaagaacgacctgtatggaacacagagcttaagtatcagcgtggggtcatctacctaccggaacaacttcgttcctgtggttggggctagaccacaggtgaatggtcagagcggcagaatcgatttccactggaccctcgtccagccaggagacaacatcaccttcagccataatggcggcctgattgccccttctagggtttccaaattgattggacgcggcctcgggattcaatcagacgctcccattgataataattgtgagagcaaatgcttctggaggggaggatccattaacacccgattgccattccagaatttatccccacggaccgtgggccagtgccctaaatacgtgaataggcgatccctgatgttggcaacaggcatgagaaacgtccctgagctgatccaagggcgcggactatttggagcaatagccggcttcttagagaacggatgggaaggaatggtggatggttggtacggtttccgacaccagaacgcccaaggaactggacaggctgccgattacaaatctactcaggccgctatagatcagattacaggaaaactgaataggctggttgagaagacgaatacggaatttgaatccattgagagtgaattcagtgagatcgaacaccagattggcaatgtgattaactggacaatggactccatcactgatatttggacttaccaggccgagctgcttgtagcgatggagaatcaacatactatcgacatggcagactccgagatgctgaacctgtatgaaagagtgcgcaagcagctgagacagaacgccgaagaagacggcaaaggctgttttgaaatttaccatgcctgcgacgactcctgtatggagtccattcgcaacaatacatacgatcacagccagtacagggaggaagcgttgctgaacaggttgaacataaatcccgtgacacttagctctggttacaaggatattatactctggttttcctttggagcttcttgcttcgtgctgctcgcagtcgtgatgggtctggtttttttttgcctcaagaatggcaacatgcgttgcactatatgtatc

SEQ ID NO: 780 - DNA, 1683 bp, Influenza A virus
  misc_feature (1)..(1683): Codon Optimized Sequence Encoding H10 Hemagglutinin
atgtacaagatcatcgtcatcatcgctctcctcggtgcggtgaagggtctggataagatttgcttgggtcaccacgctgttgccaatggcacgattgtaaagaccctgactaacgagcaagaagaagttactaatgccacagaaaccgtggagtctaccggcattaacagattatgcatgaaaggtcggaaacataaagatttggggaattgccaccctatagggatgctcatcgggactcctgcgtgcgacctccaccttaccggaacctgggacactctgattgagcgcgaaaatgcaattgcctattgttatcccggggcaacagtgaacgtcgaggccttgcggcagaagataatggaatccggcggaatcgacaagattagcaccggcttcacctacggctcctctattaattctgctggaacaactagggcttgcatgagaaacggcggcaactcattctacgccgagctcaagtggcttgtgtctaagtctaaaggacaaaatttcccacagaccaccaatacgtatcgcaatacagacactgcggaacatctaatcatgtggggcatccatcacccgagtagtacccaggaaaagaacgacctctacggcactcaatcactgtccatcagcgttggctctagcacataccggaacaatttcgtccctgtggtaggagctagaccccaggttaacggacagtcaggccgtatcgactttcattggaccttagtacaaccaggggataacattaccttttcccataacgggggactgatcgcccctagccgcgtcagtaagctcatcggacgtggactcggaatccagtcagacgcccccatcgataacaactgcgagtcaaaatgcttttggcgaggaggatctatcaacactaggctgccctttcaaaatctgtcccctcgcacagtgggtcagtgtcctaaatacgtgaaccgcagatcactcatgctcgccaccggaatgaggaatgtgcccgaactcatccaagggaggggcctcttcggtgccatcgcgggattcctcgaaaatggatgggaggggatggtggatggatggtacggctttcggcaccaaaacgctcagggcaccgggcaggccgccgattataaatctacgcaggcagctatagaccaaataaccggcaaattaaatcggctggtagaaaagaccaacaccgaattcgagagcatagagagcgaattttcagaaatagagcaccagattgggaacgtaattaactggacaaaggactctataaccgatatctggacataccaggcggaactcttggtggccatggagaatcagcacaccattgacatggccgatagtgagatgctgaatctctacgagagggtgcgaaaacagctaaggcaaaatgccgaagaggacggcaagggttgctttgagatctaccacgcctgcgacgactcttgtatggagtccattcgaaacaacacctacgaccattctcaatacagggaggaagctttgctcaatcggctcaacatcaatccagtcacgctgtcttccggttataaggacatcatcctctggtttagtttcggagcttcttgttttgtactcttagccgtggtgatgggcctgttcttcttctgcctaaaaaacggcaacatgcggtgcacaatctgtatt

SEQ ID NO: 781 - DNA, 1683 bp, Influenza A virus
  misc_feature (1)..(1683): Codon Optimized Sequence Encoding H10 Hemagglutinin
atgtacaaaatagtggtcatcatagcccttctgggtgccgtgaaggggctagacaaaatctgtttgggacatcacgcagtagcgaacggcaccatcgtcaaaacgctgacgaacgagcaagaagaggttaccaatgctacagagactgtggagtctactggcatcaataggctctgcatgaaaggacggaaacacaaggacctgggcaattgtcaccctatcggcatgttgatcggaactcccgcctgtgatctgcaccttacagggatgtgggatacgctgatcgagcgggaaaatgccatagcttactgctaccccggagcgaccgttaacgtggaggccttaagacagaagatcatggagtccggcgggatcaataagatttccactggctttacgtacggttccagtatcaactccgcagggacgacgcgcgcgtgcatgagaaacggcggcaacagcttttacgctgaactcaagtggctggttagcaagtcaaagggccagaatttccctcagaccactaacacatacaggaatactgacaccgccgagcacctcatcatgtggggaattcaccacccttcctccacccaggaaaagaacgatctatacgggacccagtctttgtccatatctgtgggcagttcaacataccggaacaactttgtgcctgtggtgggtgctaggccacaggtcaacgggcaatccggtaggattgattttcactggactctggtccagcccggggacaatataactttttcgcataatggcgggctgatcgctccctcccgggtgtcaaagctgattggacggggccttggtatacagtctgacgcgcccattgataacaactgcgagtctaagtgtttttggcggggaggcagcatcaatactcgcctcccttttcaaaacctctcccctagaacagtggggcaatgcccaaaatacgtcaataggaggtccctcatgctagcaaccggtatgcgcaacgttcccgaactgatccagggccgagggctgttcggagctatcgcagggtttctcgaaaacggctgggaaggaatggtcgatggctggtatgggttcagacatcagaatgcccagggcacaggacaggcagcagattacaaaagtactcaggccgccatcgaccagatcaccggcaaacttaataggctggtggaaaaaaccaacaccgagtttgagagtatagagagcgagttttcagagatcgagcatcagattgggaatgttatcaactggaccaaggattccattactgatatttggacttaccaggcggaactgctggttgccatggagaatcagcacacgatcgatatggccgactccgaaatgttgaatttatatgagcgggtgagaaagcagctcaggcagaacgcagaagaggacggaaaggggtgcttcgagatctaccatgcttgtgacgattcctgtatggagtcaattagaaacaatacctacgaccactcccagtatagagaggaggctctgctaaaccgccttaatatcaacccggttaccctgtcaagcggatacaaggatattatattgtggttttcttttggcgcatcttgcttcgtgttactcgctgtggtgatgggtttattcttcttttgtctgaagaatgggaacatgcggtgtaccatttgcata

SEQ ID NO: 782 - DNA, 1683 bp, Influenza A virus
  misc_feature (1)..(1683): Codon Optimized Sequence Encoding H10 Hemagglutinin
atgtacaaggtggtggtcatcattgccctgctgggggcagtcaggggcttagataagatttgtcttgggcatcacgccgtggccaacggaacgaccgtgaaaaccctcacaaatgagcaggaggaagttacgaatgccaccgagactgtggagtctacttctctgaacaaactgtgcatgaaaggccggcgttataaagatctgggaaattgtcatcctatcggcatgctgattggtactcctgtatgtgacctgcacctcacgggcacttgggatacactgatcgagagggaaaatgccacagcttactgctaccccggagtcacaattaacgaggaggcactcagacagaaaatcatggagagcggtggtatcagcaaaatgcgcaccggctttacttatggcccaagcatcaactctgccggtacaacacgaagttgcatgaggaacggcggcaatagcttctacgctgaactcaagtggttagtctccggtacgaaggggcagaattttccgcagactacaaatacataccgaaatacagatacagctgagcacctgatcatctggggcatccaccaccctagttcaacccaggagaaaaacgatttgtatggaacgcaatctctctccatttccgtagggtcctccacctatcaaaacaactttgtcccggttattggggctagacctcaggtcaatggccagagcggtaggattgagtttcattggactctcgtcagaccaggggacaacatcacgttttcccataatggcggactcatcgctccagacagggtttccaagctcatcggaaaggggattgggattcagtcaggggcagtaatagataaggactgtgagtctaaatgtttttggcggggaggttccataattaccgaactgccatttcagaatctctcccctagaacagtggggcagtgtcccaaatacgttaaaaaaaggagtttgctgctggcaacaggcatgcggaacgtccctgaggtagtacaggggcggggattattcggagcaatagccgggtttatcgaaaacgggtgggaaggtatggtggatggatggtacggcttccgtcaccaaaatgctcaggggatcggacaggccgccgactacaaatctactcagactgccatagatcagattaccggtaaactcaacaggctcatcgaaaaaacaaatactgagtttgaaagcattgagtctgagttttctgagattgagcatcagattggcaacgtcatcaactggaccaaggattccattacagatatctggacgtaccaagccgagctgctcgtggcaatggagaaccagcatacaatagacatggctgattctgaaatgctgaatctgtacgaacgtgtgagaaagcaactgaggcagaacgctgaggaggacggcaagggctgtttcgagatctatcatacctgcgataactcatgtatggaatccatccggaataatacttatgatcacagtcagtatcgcgaggaagccctgctgaatagattaaatatcaatcctgtgaaactgagttctgggtacaaagatatcatcctgtggttcagctttggggccagctgtttcgtactgctggccgtaatcatggggctaggattcttttgcctgaagaacggcaatatgcgctgcacgatttgcatt

SEQ ID NO: 783 - DNA, 1683 bp, Influenza A virus
  misc_feature (1)..(1683): Codon Optimized Sequence Encoding H10 Hemagglutinin
atgtacaaaattgtggtgataattgcccttttaggcgccgtgaagggcctcgataaaatttgccttggccatcatgcagtcgctaacgggactatcgtaaagaccctgaccaacgaacaggaagaagttaccaatgccactgaaactgtggagagtacaggcattaacaggctgtgcatgaagggacgcaagcacaaggatttagggaattgccatccgatcggaatgctgatcgggacccccgcgtgcgacctgcacctgacaggaatgtgggacacccttattgagagagaaaatgctatcgcttattgctaccctggtgccactgtcaacgtggaggccttacgtcagaagattatggaatccggaggcataaataagattagtaccgggttcacatatggctcttccataaactctgcgggcaccactagagcatgtatgaggaacggtgggaatagcttctatgctgagctcaagtggttggtcagcaagtccaaaggtcagaactttccgcagacaactaatacctaccgaaatacagacaccgctgagcacctcattatgtggggcattcaccacccgagctcaactcaagagaagaatgacttgtacggaacacaatctctgtccatctctgtgggcagcagtacctatcggaataatttcgtcccagtagtgggcgcaggacctcaggtcaatggtcagtccggtcgcatcgacttccattggaccctggtgcaaccaggcgacaacatcaccttttctcacaacggcgggctgatcgcaccctcgcgtgtgtctaagctaatcggccgtggcctggggatccagtctgatgcacccattgacaataactgcgagtctaaatgtttctggagaggcggatccattaacacgcggctgccatttcagaacctgagtccaagaacggtaggccagtgtccgaagtacgtcaatcggaggtcattgatgctggcaaccggcatgagaaatgtcccggagctgatacagggaaggggactatttggagctatcgctggcttcctagaaaatggatgggagggtatggtcgatggatggtatgggtttcgccaccaaaacgcacaggggactgggcaggccgcagattataagagcactcaagctgcaatcgaccagatcactggcaaactgaatcggcttgtggagaaaaccaacacagaattcgagtcaattgagtccgagtttagcgaaattgaacaccagatcggaaatgttattaactggactaaggattccatcacagatatctggacctaccaggcagagctattggtagccatggagaaccaacatacaatcgacatggcggattcagaaatgctgaacctgtatgaacgcgttaggaagcagctcaggcagaacgccgaggaggatgggaaaggttgcttcgagatatatcatgcctgcgacgacagctgtatggagtccatacgaaataacacgtatgaccacagccagtaccgagaagaggctcttcttaatcggctcaatataaacccagtgacactgtcatccggatacaaggacatcatactatggttcagctttggtgcctcttgtttcgtgctacttgctgtggtgatgggccttttttttttctgcctcaagaacgggaacatgaggtgtacgatatgcatc

SEQ ID NO: 784 - DNA, 1683 bp, Influenza A virus
  misc_feature (1)..(1683): Codon Optimized Sequence Encoding H10 Hemagglutinin
atgtacaagatagtcgtgatcattgccctccttggtgcagtaaagggattagacaagatttgcttgggacaccacgcggttgctaacggaacaatagttaagacactcactaatgagcaagaggaagtcacaaatgctaccgaaaccgtagagtctacgggcatcaacaggctttgtatgaaaggcaggaagcacaaggaccttgggaattgtcaccctattggtatgcttattggcaccccagcctgcgatctacatctgactgggatgtgggacaccctcatcgaacgagagaatgccatagcctattgctaccctggcgcaactgtgaatgtggaagctttgaggcagaagataatggaatccggcggaatcaacaagatatcaacaggctttacttacggctcgagtatcaattcagccggcacaactcgggcctgcatgcggaatgggggaaactctttctacgcagaactgaaatggctggtatccaagtctaagggccagaatttcccgcagaccaccaacacctatcgcaacactgacacagcagaacatttgataatgtggggtatccaccacccgtctagtacccaggagaagaacgacttgtatggcacgcagtcattatctatcagcgtgggctccagcacgtaccggaacaactttgtccccgtggttggcgcacgaccacaagtgaacggacaatccggccggatcgattttcattggacactcgttcagcccggcgacaatatcaccttttctcacaatgggggcctgatcgcgccaagccgggtttccaagctgatcggcagaggcctcggcatacagagcgatgccccgatcgataacaattgtgagtcgaaatgtttttggagaggcggctctattaacacgcgactgccctttcagaatctgagcccgcggacagtgggacaatgcccaaaatacgtaaacaggaggagtctgatgctcgcgactggcatgaggaacgttcctgagttgatccagggccggggcctatttggcgccatcgcagggttcctggagaatggttgggagggtatggtagatggatggtacgggttccgccaccagaatgcccagggaacaggccaggctgcggactacaaatccactcaggccgccatcgatcaaattaccggaaagcttaacagactcgtcgagaaaacgaatacagagtttgagtcaattgagtccgagttcagtgaaatcgagcaccaaataggaaacgtgatcaattggacaaaggacagtatcaccgatatctggacttaccaggctgaactgctcgtagctatggagaatcagcacaccatagatatggcagactccgagatgttgaatttatacgagagagtccggaaacagctgcgccagaacgccgaagaggatgggaagggctgcttcgagatataccacgcctgtgacgactcatgcatggagtctatccgaaacaatacctacgatcattcccagtatagggaagaggccttgctgaaccggttgaatattaatcctgtcacattgtctagcggctacaaagacatcatcttatggttttcgtttggtgcttcatgtttcgtgcttctggctgtggtgatgggactctttttcttttgccttaagaatggcaatatgagatgcaccatttgtatt

SEQ ID NO: 785 - DNA, 1683 bp, Influenza A virus
  misc_feature (1)..(1683): Codon Optimized Sequence Encoding H10 Hemagglutinin
atgtataagatcgtggtgatcattgccctactgggtgccgtgaaagggctggacaaaatttgcctcggccaccatgctgtcgccaacggcaccatcgtcaaaacgcttacgaatgagaaggaggaagtgaccaatgctaccgagactgtggaaagtacaggcctcaacaggctctgtatgaagggcaggaaacacaaagacttgggtaactgccatcctataggaatgctcattggcagcccggcttgtgacctgcaccttactgggacctgggatactctgatcgagagggagaatgccattgcgtattgttatccaggagccaccgtaaacggcgaggcactaaggcaaaagattatggaaagcgggggtattgacaaaatttcaacagggttcacatatgagtctagcatcaactcagccggcacaacgagagcatgcatgcggaacgggggcaattccttttacgctgagttgaagtggctggtgtccaagagcaaagggcagaatttcccacagactaccaacacctatagaaatacggatacagcagagcacctgattatgtggggtatccaccacccaagctccacgcaagaaaagaatgatctgtatggaactcaaagcctctctattagtgtggggtctagcacttaccggaacaacttcgtccctgtggtgggcgctcgccctcaggttaatggccagtccggaagaattgactttcattggactctcgtccagccaggggataatataacattctctcacaatggaggactgattgcaccttctcgggtgagcaagctgataggccgcgggctggggatccagagcgatgctccaatagataataattgcgaatcaaagtgcttttggagggggggatctattaatacgcggcttccattccagaacctcagtcctcggactgttggacaatgccccaaatatgtgaacaagcgcagccttatgctcgctaccgggatgaggaatgtccctgaattaatgcagggacgcggcctattcggagcaattgccggatttctcgagaacggttgggaaggcatggttgacgggtggtatggtttcagacaccagaacgcccaggggacagggcaggccgccgattataaatccacccaggccgccatcgaccagattaccggtaaattaaacaggctagttgaaaaaaccaataccgagtttgaatccatagaatctgaattctccgaaattgaacaccagatcggtaatgttatcaactggaccaaagacagcatcaccgacatatggacttatcaggctgagctgcttgtcgctatggagaaccagcacaccatcgacatggccgattctgaaatgctgaacctgtacgaaagggtgcggaagcagctacggcagaacgctgaggaggacggcaaggggtgctttgaaatctaccacgcctgcgatgattcctgtatggagtccatccgtaacaacacgtacgaccactcacagtatagagaggaagccctcctaaaccgcctgaatatcaaccccgtaaccctctcatctggttataaagacatcatcctctggtttagtttcggcgcctcatgtttcgtactgctcgcagtggtgatgggcctggtattcttctgtctaaagaacgggaatatgagatgcaccatctgcatt

SEQ ID NO: 786 - DNA, 1683 bp, Influenza A virus
  misc_feature (1)..(1683): Codon Optimized Sequence Encoding H10 Hemagglutinin
atgtataagatcgtggtgatcattgcactccttggggcagtcaaaggcttggacaaaatttgtttgggacaccacgcagtcgctaacggtacaatagtcaaaacactgacaaatgagcaggaagaagtgactaacgccacagaaacagtggagtccacaggcattaatcgcctttgtatgaagggtcgcaagcataaggatctggggaactgtcaccctataggtatgctgatagggactccagcctgtgatttacacctgacagggatgtgggacacgctcatcgagagggaaaacgccatcgcctactgctatcctggggctacagtcaacgtcgaggccctacgacaaaaaattatggagagcggcgggatcaataagatttccactggctttacttatggctcatctataaactccgcaggcacaacacgcgcctgtatgcgcaacggcggaaactcattttacgcggaactgaagtggctggtttctaaaagcaagggccagaatttcccacagactacaaatacctatcgcaacactgacaccgcagaacacttaataatgtgggggattcaccacccctcgagcacccaagagaagaacgacctttatggaacgcagtctctcagcatcagcgtgggatcatccacataccggaacaactttgtgcctgtggtgggagctcgaccacaagtcaacggccagtctggtagaattgattttcactggacccttgtgcaacctggggataatataactttctcgcacaatggtggtttaatagccccatctcgcgtcagcaaactgatcggtagaggcctcggaatacagtccgatgcacctatcgataacaattgtgaatccaagtgcttctggagggggggatccattaatactcggctgcctttccaaaatttgtcaccccgcactgtgggccagtgtccaaagtacgtgaacagaaggagcctgatgttggcaaccgggatgcgcaacgttcccgaactcatccaggggagaggtttgtttggagctatcgcgggctttctcgaaaacggctgggaggggatggtggatggatggtacggctttcgtcaccagaacgcccagggaacggggcaagcagccgattacaagagcacccaggccgctatcgaccagattacggggaagctgaaccgcctagtagagaagaccaacacagaattcgaatctattgaatcagagtttagcgaaatagagcatcagatcggaaacgtgatcaattggactaaagattctatcacagatatctggacttaccaggctgaactgcttgtagcaatggagaatcaacacacaatagacatggccgattctgagatgctgaacctgtacgagcgtgtacgcaaacagctgagacagaacgccgaagaggatggtaaaggatgtttcgaaatctaccatgcttgcgacgactcttgcatggaaagtatccggaacaatacatacgatcactcccaatatcgcgaggaggcgctgctgaacagactgaacattaaccccgtgactctatcctcagggtacaaggatatcatattatggttctctttcggcgcctcctgtttcgtcctgctggccgtcgtaatgggccttttctttttctgtttgaagaatggaaatatgcggtgcaccatctgtata

SEQ ID NO: 787 - DNA, 1683 bp, Influenza A virus
  misc_feature (1)..(1683): Codon Optimized Sequence Encoding H10 Hemagglutinin
atgtacaaaatcgtggtaattattgctcttcttggggctgttaaagggttggacaagatttgtctcgggcatcacgccgtggccaatggaacgattgtgaagacactgaccaacgaacaggaggaggtaactaacgccacggaaactgtcgagtccactggcatcaatcggctctgtatgaagggccgcaaacacaaggacttggggaactgccacccaatcggcatgcttatcggcacacccgcttgtgacttacatctgactgggatgtgggacacgcttatagaacgggaaaacgccattgcctactgctacccaggtgcaactgttaacgtcgaagctctgcgccaaaagatcatggaaagcggcggtatcaacaaaattagtacgggctttacctatggctcaagcattaactcagctggcaccacccgtgcctgtatgaggaatggaggcaactccttttacgctgagctcaagtggctcgtgtccaagtccaagggacagaatttcccccagactaccaatacctatagaaatactgacaccgctgaacacttgattatgtggggtatccatcaccctagctccactcaggaaaaaaacgatctatacggcacccagtcgttgtccatctcagtcggcagttccacttatcgcaacaactttgtgcccgtggtcggagcacgtcctcaggttaatggccagtctggccgtatcgattttcactggacactggtacagcctggcgataatattacttttagccacaacgggggcctgatcgccccgagtcgtgtgtccaagcttatcggacgaggtcttgggattcaatctgatgccccaattgacaataactgtgaaagcaaatgcttttggcgcgggggatccattaacacgcggcttcctttccagaatctatcccctcgtactgtcgggcaatgccctaagtacgtcaaccggaggtccctgatgctggccactggcatgcgtaacgtcccagagctcattcagggcagaggtttattcggagcaattgcagggttcctggagaacggctgggagggaatggtcgatggctggtatggtttccgccatcaaaacgctcaaggcacaggccaggcggccgattacaaatcgactcaggcggccattgaccaaatcacaggcaaactgaatagactggtggaaaaaacaaacaccgagtttgagtctattgaatctgagtttagcgaaatcgagcaccaaatcggcaatgttattaactggactaaggattcaattacggatatttggacataccaggcggagttattagttgccatggagaatcagcacactattgatatggctgatagtgagatgttaaatttgtacgagagggttaggaagcagttgaggcagaacgcggaggaagacgggaaaggctgcttcgagatttaccacgcctgcgacgattcctgcatggagagcatccggaataatacctacgaccattcacagtatcgagaagaagctctattaaaccgtttgaacatcaacccagtgaccttaagtagcggatacaaagacattattctatggttctccttcggcgcctcctgtttcgtgttgctcgccgttgtaatgggattgtttttcttctgtctgaagaatggaaacatgagatgcacaatttgtatc

SEQ ID NO: 788 - DNA, 1683 bp, Influenza A virus
  misc_feature (1)..(1683): Codon Optimized Sequence Encoding H10 Hemagglutinin
atgtacaagattgttgtgatcatcgcccttctgggggccgtgaagggacttgacaaaatatgcctcggtcatcacgctgttgtgaatggcacaatagttaaaacgctgaccaacgagcaagaagaggtgaccaacgcaaccgagacagtggagagtacaggtctgaaccgactgtgcatgaagggccgaaaccacaaggacctcggcaattgtcaccccatcggaatgttaattggtacccccgcctgcgatctgcatctgaccggtacttgggataccttaattgaaagggaaaacgccatcgcgtactgttatcccggagcaaccgtgaacgaggaagccctcagacagaagatcatggagtcgggaggcatcaacaagatctccacaggcttcacgtacggctcctctattaattctgccggaacaactcgggcctgtatgcgcaacggaggcaactccttctacgcagaactgaaatggcttgtcagcaagagcaagggtcagaatttcccccaaactaccaatacttataggaatacggacaccgcagaacacctgataatgtggggcattcatcatccctcttcaactcaggagaaaaatgatttgtatgggactcaatccttatcaatctccgtgggtagcagcacctatcagaataactttgttccagtcgtaggggcccggcctcaggtgaacgggcagtcaggcagaattgatttccactggacccttgtgcaacccggagacaacattacctttagtcacaatggcggtctcatcgccccttccagagtgtctaaactgatcggtcggggcctgggcatccagagcgacgcaccaatcgacaataattgcgagagtaagtgcttctggagaggtggtagtatcaatactaggctcccattccaaaatttatcgcctaggaccgtcggacagtgtcccaaatatgtaaataaaaggtccttaatgcttgcgacgggaatgcgtaacgttcctgaactgatgcagggcagaggcctatttggcgcaatagccggttttatcgagaacggctgggaggggatggtggacggttggtatggatttaggcaccaaaatgcccagggaactgggcaggcggcggattacaagagcacacaagctgctatcgaccagatcacgggcaaactgaatcgattgattgaaaagaccaacactgagtttgaatcaattgagagtgagttttcagagattgaacaccagatcgggaacgtgataaactggactaaagattccatcactgacatctggacatatcaggcggagctcctggtggccatggagaaccaacacaccatcgacatggcagactctgaaatgttaaatctgtacgagagagtcaggaaacagctgcgccagaatgccgaggaagatggcaagggttgcttcgagatctaccacgcatgtgacgacagctgcatggagtcaattcgcaacaacacctacgaccactcccaatacagggaggaggcactgcttaacaggctgaacattaatccggtcaccctctctagcggctataaggatattattctgtggttcagttttggcgcttcttgttttgtcctgctggcagtggtgatgggcctggtcttcttttgcctaaaaaatgggaatatgaggtgcaccatctgtatt

SEQ ID NO: 789 - DNA, 1683 bp, Influenza A virus
  misc_feature (1)..(1683): Codon Optimized Sequence Encoding H10 Hemagglutinin
atgtataaaattgtggtcatcattgctctgctgggtgcagtaaaggggctggacaaaatttgtctgggacaccatgccgttgccaacggaacaatcgtgaagacgcttactaacgaacaggaagaagttaccaacgctaccgaaaccgtcgaatccacgggtatcaacaggctgtgtatgaaagggaggaagcacaaagatttggggaactgccacccaatcggcatgttgattggcactcccgcctgtgatctgcatttaactggtatgtgggataccctgatcgagcgagaaaatgctattgcatactgttatccaggcgcgactgtgaatgtcgaagctctgcgacagaaaatcatggaatccggcggtatcaataaaatttcgacaggcttcacatatgggagttctattaactctgccgggaccaccagagcctgcatgcgcaacggaggaaatagcttctacgctgagttaaagtggctagtctctaaatctaaaggacaaaacttcccacagaccactaacacctaccggaataccgataccgcggaacacttaattatgtgggggatccaccacccaagctctacgcaggaaaagaacgatctctacgggactcagtctttatcaatttccgtgggctcctctacataccgcaataatttcgtgcccgtggttggcgctaggcctcaggtaaacgggcagagtggaaggatagattttcactggaccctggttcagccgggcgacaacatcactttcagtcacaatggcggccttatcgctcccagccgggtgtctaaattgatcggcaggggactgggtatccagtcggacgctccaattgacaacaattgtgagtcaaagtgcttttggcgaggggggagcatcaacactcgcctccctttccaaaacctgtctcctcggacggtcggacaatgccctaagtacgtaaacaggcggtcgctgatgctggccactgggatgagaaacgtgccagaacttattcagggccgtggcttgttcggcgcaatcgctgggtttcttgaaaatggctgggaagggatggtggatggttggtatgggttccgacatcagaacgctcagggcactgggcaggccgctgattataagtccacccaggcagctatagaccaaataacagggaaactaaatcgcctggtcgaaaagacaaatacagagttcgaatctatcgagagcgaattctcagaaatcgagcaccagattgggaatgtgattaattggaccaaggatagtatcacagatatctggacataccaggcagaactgttggttgccatggaaaaccagcacaccattgatatggcagattcagagatgcttaacctgtatgagagagtgcgaaagcagctgcgccagaacgcagaagaggatggaaaggggtgcttcgaaatttaccacgcttgcgatgatagctgtatggagtcaataagaaacaacacctatgaccacagccagtacagggaggaggcactacttaataggctgaatatcaatccagttactttgtccagcggctataaggacattatactgtggtttagctttggggcgtcctgctttgtgctcctggctgtagtgatggggctatttttcttctgtttaaagaacggtaatatgcggtgcacaatctgtatc

SEQ ID NO: 790 - DNA, 1683 bp, Influenza A virus
  misc_feature (1)..(1683): Codon Optimized Sequence Encoding H10 Hemagglutinin
atgtacaaaatagtgctggtgctcgccctcctcggtgctgtgcatggtcttgacaagatatgtctcggacatcacgccgtcccgaacggaactattgtgaaaaccctaaccaacgagaaggaagaggtgactaacgcgaccgaaactgtggaaagcaagagtctggataaactgtgtatgaagaataggaattacaaggacctgggcaattgtcatcctattgggatggtggtcggtacccccgcttgtgatcttcatctgaccggaacctgggataccctgatagagcgcgacaattcaattgcgtattgctaccccggtgccacagttagcgaggaagccttgcgccagaagatcatggagagtggcggcatagataaaatcagcaccggattcacgtacgggagtagtatcaattcagccggcacaacaaaagcctgcatgagaaatggcggaaactccttttattctgaactgaaatggctcgtgtccaagaacaagggccagaactttcctcagacgaccaatacttatcgcaacacagattccgtcgaacatttgatcatttggggcattcaccatcctagctctacccaggagaaaaacgatctgtacggcacccaaagcctgtccattagcgtcgggtccagtacataccagaacaacttcgtgccagtcgtcggggcgcggccgcaggtcaacggccagtcagggagaatagactttcattggaccatggtgcagcccggggacaacattactttttcccataatggaggcctgatcgcaccaaatcgggtctctaagctgaaagggagaggtctcgggatccagtccggagcatctgtggacaacgactgtgaatccaaatgcttctggaagggtgggtctatcaataccaagctcccctttcagaatctctcgcctaggaccgtgggacagtgcccaaaatacgtgaacaaaaaaagtctcctcctggctactggtatgcggaatgtcccagaggttgcacaggggcgaggcctgttcggtgccatagcgggttttattgagaacggttgggagggaatggtggatggctggtatgggtttcggcaccaaaatgcacagggcacaggtcaggccgccgattataagagcacacaggcagccattgatcagattacagggaagctgaatcgactgatagaaaaaacaaataccgagtttgagtccattgaaagcgaatttagcgagattgagcaccagatagggaatgtcatcaattggaccaaagattcaatcactgatatttggacttaccaggctgagctgctggttgcaatggaaaatcagcacacaattgacatggccgacagcgagatgctgaacctctacgagagagtgcgtaaacagctgcgccagaacgcagaagaggatgggaagggatgtttcgaaatttatcacaagtgtgatgacaactgtatggagagcattcgaaacaacacgtacgaccatactcagtatcgggaggaagccctgttgaatcgcctcaatattaatcccgtgaaactctcatccggttataaagacgtcatactgtggttttccttcggggccagctgcttcgtactgctggccgtcattatgggccttgtttttttctgtctgaaaaatggaaacatgaggtgtaccatctgtatt

SEQ ID NO: 791 - DNA, 1683 bp, Influenza A virus
  misc_feature (1)..(1683): Codon Optimized Sequence Encoding H10 Hemagglutinin
atgtataaaatcgtggtgatcatcgcactgctgggtgcggttaaggggctcgacaagatttgcctgggacaccatgcagtggcaaatggcactattgtcaaaacacttactaacgagcaggaggaagtgacaaacgccacggagaccgttgagagcacgggcatcaatcggctgtgcatgaaaggcaggaagcataaggacctcggcaactgccatcctattggtatgctgattggcacgcccgcttgcgatctgcatctgaccggaatgtgggatacgcttatagagagagagaacgcgattgcctactgctaccccggcgctacagtcaatgtcgaagctctgcgccaaaaaattatggaatctggcgggattaacaagatctccactggcttcacgtatggatcttcaataaactcagccggcaccacacgggcctgcatgcgcaatgggggaaactcattctatgctgaactgaaatggcttgtctcaaaatctaaggggcagaattttcctcaaactaccaacacctacaggaatacggataccgctgagcacctgatcatgtggggtatccaccacccttcgtccacccaggaaaaaaatgacctatatggtacccagtcactgagtatcagcgtaggcagttctacatatcgtaacaactttgtcccagtagtcggggcccgccctcaagtgaacggccaatctggacgtattgatttccactggacactggtgcaacccggagacaacatcactttctcccacaacggagggctgatagccccctccagggtctccaagttgatcggacgtggacttgggatacagtctgatgccccaattgataataactgtgagtctaaatgcttctggagggggggcagtatcaatacacgcctgcctttccagaacctgtcgccacggacagttggacagtgtccaaaatatgtgaaccgcaggtcgctgatgttggcaaccggaatgaggaatgtgcccgagctgattcagggtcggggattatttggcgccatcgcagggttcctggaaaatggatgggaaggcatggtggatggatggtacggctttagacaccaaaacgcccagggaacagggcaagcagcagactacaaatccacgcaagctgctatagaccagattactggtaagctcaaccgtctcgttgagaaaacaaatacggaatttgagagtatcgagtcagagttttctgaaatcgaacatcaaatagggaatgtaattaattggacaaaagactcaatcactgacatatggacctatcaggctgaactgctagttgcaatggagaatcaacataccatcgacatggctgacagcgagatgctgaatttgtacgaacgggtcagaaaacaactgcggcagaatgctgaggaagatggaaaggggtgtttcgaaatatatcacgcttgtgatgactcttgcatggaatccatccggaataatacctacgatcactcgcagtatcgagaggaggccctgctgaatcgcttaaacattaatccagtgacactgtcttccgggtataaagatatcattctgtggttttcctttggcgcatcctgcttcgtattactagccgttgtcatgggattgtttttcttttgtctgaaaaacgggaacatgcggtgtaccatttgtatt

SEQ ID NO: 792 - DNA, 1683 bp, Influenza A virus
  misc_feature (1)..(1683): Codon Optimized Sequence Encoding H10 Hemagglutinin
atgtacaagatcgtggtcatcatcgctctgttgggcgccgtgaaagggcttgataagatctgtcttgggcaccacgccgtggccaacgggaccattgtgaaaaccctcacgaacgagcaggaggaagtgacaaacgcaactgagaccgttgagtcaaccggtattaatcgcttgtgcatgaaaggacgaaagcacaaggacttgggcaactgccatccaattgggatgctgatcggtaccccagcatgtgatctgcatttaacaggcatgtgggatacccttattgagcgagaaaatgccatcgcgtattgctatcctggagccactgtgaatgtggaggcactgcgtcagaagattatggaatctggcgggatcaataaaataagcaccggctttacatacggcagctcgattaattccgctggcaccactagagcttgcatgcgcaatggcggcaactcattctatgccgagctgaagtggttggtgagtaagagcaaagggcagaactttcctcagaccaccaacacctatcgaaatacggacacagctgaacaccttataatgtgggggatccaccacccgtcatctacccaggaaaagaacgacttatacggaacacagtctctgtccatctcggttggatcctctacttaccgaaataattttgtgcccgtcgtgggggccagaccccaggtaaacggacagtctggcaggatcgatttccattggactctggtccagcccggagataatatcacctttagtcacaacggtggactgatcgctcccagtagagtgtccaagctgataggcagagggcttggaatccaaagcgacgccccaatcgataataactgcgaaagcaagtgtttctggcggggcggatccatcaacaccaggcttcccttccagaacttgtccccaaggactgttggacagtgcccaaagtatgttaatcgacggagtctgatgctcgctactggcatgagaaacgtacccgagctgatacaagggcgcgggctgttcggcgcaatagccggattcctggagaacggatgggagggtatggtggacggctggtatggctttcggcatcagaatgcccagggtactggtcaggcagccgattataagtcaacccaggctgccatcgatcagattacagggaaactgaatcggctggtggaaaaaaccaataccgaatttgagtccattgaatctgaattcagcgagatcgagcaccagatcggtaatgtcataaattggactaaggattccatcacagatatctggacataccaagctgagctgcttgtggccatggaaaaccagcatacaatagacatggccgacagtgagatgctaaatctgtatgagagagtgagaaaacaactaagacagaatgctgaggaggacggcaaaggttgttttgagatctaccacgcttgcgacgactcgtgtatggaatccatacgcaacaatacttacgaccactctcagtaccgcgaggaagctttacttaaccgcctgaatattaaccctgttaccttatccagtgggtacaaagacataatattgtggttcagttttggcgcgtcgtgttttgttctcctggccgttgtgatgggcctgttttttttctgcctgaagaacgggaatatgcgctgtactatctgcata

SEQ ID NO: 793 - DNA, 1683 bp, Influenza A virus
  misc_feature (1)..(1683): Codon Optimized Sequence Encoding H10 Hemagglutinin
atgtacaagataatcgtcattatcgcactgttgggcgccgttaaaggactggataaaatctgcctgggccatcacgcagtcgctaacggtacaatcgtgaaaactctgaccaatgagcaggaggaagtcaccaacgcaaccgaaaccgtagagtccaccggcatcaaccggctctgtatgaagggccgcaagcataaagacctgggtaactgccaccccataggcatgcttattggcactccggcatgcgacttgcacctgacggggacctgggacacattgattgaacgggaaaatgctattgcttattgctatcctggagccacagtgaatgtggaggctctccgccaaaagatcatggaatctggggggatagataagattagtactgggtttacgtatgggagttctatcaacagcgccgggaccacaagagcctgtatgagaaacggaggaaacagcttttacgcagagttgaaatggcttgttagtaaatctaaggggcagaatttccctcagaccacgaacacttacaggaatacggatactgcggagcaccttattatgtggggcatccatcatccctcctctactcaggagaaaaacgacctctatggcactcaatccttgtccatctccgtcggttcctcaacctataggaacaactttgtgccagttgtaggcgcaaggccacaggttaacgggcagagcggtcgcatcgacttccactggaccctggtgcagccaggcgataacatcaccttttcacacaacggcgggctgatcgcaccttcccgagtgtctaagctgatagggaggggcctcggcatccagtctgacgcaccaattgacaataattgtgagtccaagtgtttttggcgcggaggttcaattaacacgcgcctgccctttcagaatctgtctccccgtactgtgggccagtgtccaaagtatgttaataggcggtccctcatgctggctacgggaatgagaaacgtgcctgagctgatacagggccgaggactattcggggcgatcgccggctttttagaaaacgggtgggagggcatggtcgacggatggtatggcttcagacaccagaatgcgcaggggactggccaggctgctgactataagagtacccaggccgctatagaccagatcacgggtaagctgaatcgtctggttgaaaagactaatactgaatttgaaagcatcgaaagcgagtttagcgaaattgagcatcagatcgggaacgtcattaattggactaaagactccattactgatatctggacgtaccaggctgagttgttagtggccatggaaaatcagcataccattgatatggcagatagcgaaatgctgaatctgtacgagagagttcgtaagcagctgcgccagaacgctgaagaggacggaaagggatgctttgagatctaccacgcctgcgacgacagctgtatggaatcgatccggaacaacacctatgaccactcccagtatagggaagaagccctgttaaaccgcctgaatattaatcccgtcactctgtcatccggctataaggacataattctttggtttagcttcggcgctagttgctttgtgctactggctgtcgtgatgggcctcttttttttttgccttaaaaatggcaatatgaggtgtacaatctgtatc

SEQ ID NO: 794 - DNA, 1683 bp, Influenza A virus
  misc_feature (1)..(1683): Codon Optimized Sequence Encoding H10 Hemagglutinin
atgtataagatcgtcgtaatcatcgccctgctgggcgctgttaaggggctggataagatctgcctaggccaccatgccgtagccaatggtacaatcgttaagacattaaccaatgagcaggaggaggttacaaacgctaccgaaaccgttgagagcaccgggattaaccgactctgtatgaagggtaggaaacataaggacctcggcaattgccatcctattggcatgctcatagggaccccagcgtgtgacttgcacctcactggaatgtgggacactctgatcgagagggaaaatgccatagcttattgttacccaggagccacagtgaatgtggaagccctgagacagaagatcatggagtccggcggaatcaacaagatcagcactggtttcacctatgggagtagcataaacagcgctggtactacccgagcatgcatgcggaatggaggcaatagcttttacgctgaactgaaatggctggtctcaaaatcgaaagggcagaattttcctcagacgacaaatacctatcgcaatacggacaccgcagaacacctgattatgtggggtatccaccatcctagctccacacaggagaaaaatgatctgtacggaacccagtccctgtctatctccgtgggatcctccacttaccggaacaattttgttcctgtcgtgggggctcggccgcaagtgaacggtcagagcggacgaattgatttccactggactctggtgcagcctggggacaatatcacgttctcccataacggaggactgatcgcccccagccgcgtgagcaagttgattgggcgcggccttggaattcagtcagatgcgccaatagataataattgtgaatctaagtgtttctggaggggaggctccatcaatacccggctccctttccaaaatttgtccccgagaacagtgggtcagtgcccaaaatatgtgaaccgccgatctctgatgctggccaccggcatgaggaacgtgcctgagctgattcagggtagaggcctgtttggagccatcgccggctttttagagaacggctgggaaggaatggtcgacggatggtatggcttcaggcaccagaacgcccaagggactggccaggcggctgactacaagtccactcaagcggctattgaccaaattacaggaaagctgaatagactcgttgaaaaaactaatacagagtttgaaagtatagaatctgagttctcagaaatagagcatcagattggaaacgtgatcaactggactaaagactctatcaccgatatttggacgtatcaggcggagttgctcgtcgcgatggagaaccaacacacaatagatatggctgattctgagatgctgaacttgtacgaacgggtgcgtaaacaactgcgccaaaatgctgaggaggacgggaaggggtgttttgagatctaccatgcttgcgacgatagctgcatggagtcaattcgaaataacacgtatgaccacagccagtacagggaagaggccctgctgaacaggctgaatataaatcccgttaccctctcctctggatacaaagacatcatcctctggttttcattcggagctagttgcttcgtactactagctgttgtaatgggcctgttcttcttctgtctcaagaatggtaacatgcggtgtacgatctgcatc

SEQ ID NO: 795 - DNA, 1683 bp, Influenza A virus
  misc_feature (1)..(1683): Codon Optimized Sequence Encoding H10 Hemagglutinin
atgtataagatcgtggtgatcattgccctcttgggcgccgtgaagggtctggataaaatatgtcttggtcaccacgctgtggctaatggtaccatcgtgaagacgcttaccaacgaacaagaggaagtgacaaatgctaccgagaccgtggagtctaccgggatcaaccgactgtgcatgaaaggacgaaagcacaaagacctcggcaattgccaccctattgggatgttgattggcactccagcttgcgaccttcacctgaccggaatgtgggacacgctcatcgagcgcgagaacgccattgcctactgctaccccggggccaccgttaacgtggaagcacttaggcaaaaaattatggaatccggtggaataaacaagattagcactggtttcacttatgggagtagtattaactctgccgggacaaccagggcttgtatgagaaatggcggcaattcattttacgcagagctcaagtggctggtttcaaaaagtaaagggcagaatttcccgcaaaccactaatacctacaggaacacagacacggccgagcacctgatcatgtggggtattcaccaccctagcagcacgcaagagaaaaatgacctttatggaacccagagcctcagtatttcagtgggaagcagcacgtaccgtaataattttgttccggtagtcggcgcccgaccccaggtgaacgggcagtcgggacgaatcgactttcattggacgcttgtgcagcctggcgacaacatcacctttagccacaatggcggcctgattgctcccagccgcgtcagcaagctgatcgggcgcggactgggcattcagtctgatgcccctattgataacaactgcgagagcaagtgtttttggcggggaggctccataaatactcgcttacctttccagaacctcagtccaaggaccgtagggcagtgtcctaagtatgttaacagaaggagtctcatgttagccacaggaatgcgcaatgtaccagaactcattcagggcaggggactctttggtgcaattgctgggtttctggagaacggttgggaaggtatggtcgacggctggtacggctttcgacatcaaaatgcacagggcacaggccaggcggctgattataaatccactcaggccgccatcgaccaaatcacaggaaagctcaaccgtctggtcgagaagaccaatactgagttcgaaagcatcgagtcagagtttagcgagattgagcatcagattggcaatgtcatcaactggactaaagatagcataaccgatatttggacgtaccaagcagagctacttgttgctatggagaatcagcataccattgatatggccgatagcgagatgctgaatctgtatgagagagtgagaaagcagttgagacaaaacgcggaggaggatgggaagggctgtttcgagatctaccacgcctgcgacgactcctgtatggagtctatacgcaacaacacatacgaccacagccagtatagggaggaagccttgctgaataggctgaatatcaatcctgtaacgctgtcgagtgggtacaaagacatcattttatggttcagttttggagcctcttgtttcgttttgctggccgtcgtcatgggactattttttttttgtttaaagaacgggaacatgagatgcactatttgcatc

SEQ ID NO: 796 - DNA, 1683 bp, Influenza A virus
  misc_feature (1)..(1683): Codon Optimized Sequence Encoding H10 Hemagglutinin
atgtacaagattgtgttggtcctagccctcctcggcgctgtgcatgggctggataagatctgccttgggcaccacgccgtgcctaatggcactatcgtgaaaacactcacaaacgaaaaagaggaagtaacaaatgccaccgagactgtggaaagcaagagccttgataaactctgtatgaaaaacagaaattataaagatttaggcaactgtcatcccattggtatggttgtgggaacgcccgcttgtgatctgcatttaacgggtacatgggataccctcatcgagcgagataactcaatcgcctactgctacccgggcgccactgtgtcagaggaagccttgagacagaagattatggaatccggcggtattgacaagatttctaccgggtttacgtatgggtcttccataaactccgcaggcaccacaaaggcatgcatgagaaatggtggtaattctttctactcagagcttaaatggctggtgtctaagaacaaaggccagaactttccccagacgaccaacacataccgtaacacggacagcgtcgagcacctgatcatctggggcattcaccatccttcctcaactcaggagaaaaacgatctctatggtacccaaagcctctctatttcagtcggatcaagcacataccagaacaactttgtgcccgtcgttggagccaggccacaggtgaacggccagagtggtcgaattgattttcactggacaatggtgcaacctggggataatatcacattcagccataatggtggtctgatcgccccaaatagagtttcaaagcttaagggcaggggtctggggattcaaagcggtgcttccgtcgataatgactgtgagtcaaaatgcttttggaaggggggcagcatcaatacaaagctaccgtttcagaacctcagtcccaggacagttgggcagtgtcctaagtatgtgaataaaaaatccttactgttggccactggaatgagaaacgttccagaggtagctcagggccgtggtctctttggggccatcgccggctttattgaaaacgggtgggaaggaatggttgatgggtggtatgggttcaggcatcagaacgcccagggcactggacaagcagctgactataagagcacacaggctgctattgaccagattactggaaaactgaataggttgatagagaagaccaacactgagttcgagtctatcgagtcagagttttcagaaatcgagcatcagatcggtaacgtaatcaactggaccaaggactcaataaccgacatctggacatatcaagccgagttgctggtagctatggagaatcaacatactatcgacatggctgattccgaaatgctcaacttgtatgagcgcgtgcgtaagcagttgagacagaatgctgaggaagatggcaagggctgcttcgagatttaccacaagtgtgacgataattgtatggagagcattcgaaacaacacttacgaccacacccaataccgcgaggaagccctgttgaatcggctcaacatcaatcccgtaaagttgtccagtggttataaagacgtcatcttatggtttagttttggagcttcttgttttgtgctcctggcagtcattatgggactggtattcttctgcctgaaaaatgggaatatgagatgcactatctgtatc

SEQ ID NO: 797 - DNA, 1683 bp, Influenza A virus
  misc_feature (1)..(1683): Codon Optimized Sequence Encoding H10 Hemagglutinin
atgtataaaattgtcgtgattattgctctgctcggtgccgttaagggactcgataagatctgcttaggacatcacgctgtagtgaacggcacaatcgtgaaaacactcacgaacgagcaggaagaggtcacaaacgccacagaaactgtcgagagcaccggtctaaaccgactgtgtatgaaaggaaggaatcataaggacctaggcaattgtcacccaatcggaatgcttatcggcacccctgcatgcgatttgcacctgacaggtacatgggatacgctgatcgagcgcgagaatgccatcgcctattgttaccccggtgcaaccgtaaacgaggaggccctgaggcaaaagataatggagtcaggcggcataaataagattagcaccggttttacctatgggagcagtataaatagtgccggtactacgcgcgcatgtatgcgcaatgggggcaactctttttacgccgaactcaagtggctagtgtcaaaatcgaagggccagaactttccacagaccactaacacttataggaacacggacacagccgaacatttaataatgtggggtatccatcacccaagttccactcaggagaaaaacgatttatacggaactcagtcgctgtcaatcagcgtagggagctcaacataccagaacaactttgttccagtggtgggcgcacgtccccaggtgaacggtcaaagcggccggatagattttcactggaccctggtgcagcctggagataatattacttttagtcacaacggtggcctaatcgcacccagtcgtgtatcgaagcttatcggacggggcctcgggatacagtctgatgctcccatagacaacaactgtgagtctaagtgcttttggcggggcgggtctattaacaccaggctcccatttcagaacctcagtcctcggaccgtgggtcagtgtccgaagtatgttaataagcgttctctcatgctcgccactggaatgaggaacgtgccagagctaatgcagggaagaggactgttcggggccatagccggcttcattgaaaatggctgggagggtatggttgacggatggtacggcttccgacaccagaatgctcaaggcacaggccaggctgcagattataaatcaacacaggctgctattgaccaaatcactggcaagctcaatcgattaattgaaaaaacaaataccgagtttgaaagcatcgagagtgaattttccgagatcgaacaccaaatcggaaacgtgatcaactggaccaaggactctatcaccgatatatggacctatcaggcagaacttttagttgccatggagaaccagcataccattgatatggccgacagcgaaatgctgaacttgtatgagcgggtccggaaacaattacgccagaatgccgaggaagacggaaaagggtgctttgagatctatcatgcttgcgacgactcttgtatggagtcaatcagaaataatacttatgaccatagtcagtatagggaagaggcgctgctcaacagactaaatatcaaccccgttacgctgagctccggttataaggacatcattctttggttttcctttggcgcaagctgctttgttctgctagctgtagtgatgggactcgtctttttctgcctgaagaacggaaacatgcgctgtacaatctgtatt

SEQ ID NO: 798 - DNA, 1683 bp, Influenza A virus
  misc_feature (1)..(1683): Codon Optimized Sequence Encoding H10 Hemagglutinin
atgtataagatcgttgtgatcatcgccctgctgggcgccgtgaaagggctggacaagatttgtctgggtcaccacgccgtcgccaacgggacaattgttaaaacactgactaacgagaaggaggaggtgactaacgcaaccgagacagttgagtccacaggattgaatcggctttgtatgaaaggccggaagcacaaagacctgggaaactgccaccctatagggatgctgatcggaagtcctgcttgtgatctacacctgacaggtacttgggacacactgatcgagcgggagaatgccattgcttactgctacccaggagccaccgtgaatggtgaagctctgagacagaagattatggaatccggaggcattgataaaatctctacaggatttacatacgagtcctcaatcaattcagctggcacaactcgagcatgtatgcgcaatggcgggaatagtttttatgccgagctcaagtggctcgtctctaaaagcaaggggcagaactttccccagaccacgaacacctatagaaataccgatacagccgagcatcttattatgtggggcatacatcatccctcctctacacaagagaagaatgatctttacggaacgcagtccctctcgatcagcgtgggaagctccacatataggaacaattttgttcccgtggttggcgctcgtcctcaggtgaacggacagagtggccgaatcgactttcactggacccttgttcagcccggcgacaacataacgttttcgcataatggcggcctcattgcaccttcccgtgtcagcaaactgattggccgcgggctgggcatccaatctgacgctcccatcgataacaactgcgaatcaaaatgcttctggaggggagggtctattaatactcggctgccattccaaaacctttccccccggacagttggccagtgtccgaaatatgtgaacaaacggagtttgatgctcgctaccgggatgcggaacgtgcctgaattgatgcagggaagaggtcttttcggcgccattgccggcttcttggaaaatggttgggaagggatggtcgacggatggtatggatttcggcatcagaacgctcaaggcactgggcaggcagctgattataaatcaacccaggctgccattgaccagataactggcaaactcaacaggctggtggagaagaccaacaccgaattcgagagtattgagtctgaattcagcgagatcgagcaccagatagggaacgttattaactggaccaaggattctattacggacatttggacataccaagctgagctcttagtggccatggagaatcagcataccattgacatggccgattctgagatgcttaatctctatgagagggtgagaaagcagctgcggcagaatgccgaagaagatggcaaggggtgctttgagatttaccacgcttgcgatgattcatgtatggaatctattcgcaataacacctacgatcattctcagtatcgggaggaagccctgctgaatcgcctgaacattaatcccgtgacactttcaagtggttacaaggacataattctatggttcagttttggggctagttgttttgtgctcctagccgttgtgatgggtcttgtcttcttttgtttgaagaacggaaatatgcggtgtacaatctgtata

SEQ ID NO: 799 - DNA, 1683 bp, Influenza A virus
  misc_feature (1)..(1683): Codon Optimized Sequence Encoding H10 Hemagglutinin
atgtacaagatcgtggtgatcattgcgctcctgggcgccgtcaagggactggacaagatctgcctgggccatcacgctgtggcaaatgggacaatcgtgaaaacgctgactaacgagcaagaggaggtgacaaatgcgacggagacagtggaatcgactgggattaaccgactgtgtatgaaaggaagaaaacataaagacctcggaaattgccatcccattgggatgctgatcggaactccagcctgtgacctgcacctgacaggaatgtgggataccctgattgagcgggagaatgctatcgcatattgttaccccggggctaccgtaaacgtcgaagcccttaggcagaagataatggaaagcggtggcatcaataagatttcgacaggcttcacttatggaagtagtattaatagcgcaggaaccactcgagcctgtatgagaaacggcggtaacagcttttatgctgagctcaagtggcttgtctccaagtctaagggacagaatttcccacagactacaaacacttacaggaataccgatacagctgagcatctaattatgtggggaatacatcacccttcttccacccaggaaaaaaacgacctctacggcactcaatctctcagcatatcggtggggagttcgacttaccgaaacaactttgtcccggttgtcggtgccaggccccaggtgaacggacaaagcggtcggatcgattttcattggactttggtccagcctggggacaatatcacattctcacataacggcggattaattgccccctctcgcgtgtcaaagctcataggccggggcctggggattcagtctgacgctccaattgataataattgcgagtcaaaatgcttctggcgcggggggtctattaatactcgattgccattccagaatctcagtccccggaccgtggggcagtgcccaaagtatgtgaaccggcggagcctgatgctggctactggaatgcggaatgtgcccgaacttattcagggccgaggtctgttcggcgccatcgccgggttcctggagaatgggtgggagggcatggtcgatggatggtatggatttcgtcaccagaacgcacagggcacaggacaggctgccgactataagtctacacaagcggctatcgaccagattactggtaaactcaaccggctggtggagaagaccaacactgagttcgaatccattgaatctgaattttcggagatcgaacaccagattggaaacgtgatcaactggaccaaggactcaatcactgacatctggacttaccaggccgaactgcttgtggctatggagaatcagcatactatcgatatggccgactccgaaatgctcaacctttacgagcgagtgcggaaacaattgagacaaaacgccgaagaggatgggaagggctgttttgaaatataccacgcctgcgatgatagttgtatggagtcaatcaggaataacacttatgatcatagtcagtatagagaggaagctcttctgaatcgactgaacatcaacccagtaacacttagtagtgggtacaaagacatcatcttgtggttctcattcggagcctcttgttttgtgctgcttgccgtcgtaatgggactgttttttttttgtctcaagaacggcaacatgaggtgcactatttgcatt

SEQ ID NO: 800 - DNA, 1683 bp, Influenza A virus
  misc_feature (1)..(1683): Codon Optimized Sequence Encoding H10 Hemagglutinin
atgtacaaaatcgtggtgatcatcgcactgctaggggcagtgaaaggcctggataaaatctgcctgggacaccacgcagtagccaacggtaccattgtgaaaacactgacaaacgaacaggaggaggtcacaaatgctacagagaccgtggagtctacaggtattaatcggctgtgcatgaagggaagaaagcacaaggatctggggaactgccaccccattggaatgctcatcgggacacctgcatgcgatctgcacctcactggcatgtgggacacattgatcgaaagagaaaatgccattgcatattgctatcctggagcaacggtcaatgtggaagcactgaggcaaaagatcatggagtccggaggcatcaacaaaatctcaaccggtttcacatacggaagcagtattaactctgccggcacaacccgtgcttgcatgcgaaatggagggaactctttctacgcggaactcaaatggttggtgtctaagtcgaaaggacagaactttccgcaaactacaaatacttacaggaatactgacactgcagaacatctgatcatgtggggcatccaccacccctcttcaacacaggaaaagaatgacctgtacgggacccagagtctgtcaatctccgtgggctcctcaacttatcgtaacaactttgtccctgttgtgggagcacgacctcaagtgaacggacagagcgggagaatcgattttcactggaccctcgtgcagcctggagataacatcacatttagccataacggagggttgatcgctccgtcccgtgtgtctaaacttatcggacggggcctgggtatccagagtgatgcaccaatcgataacaactgtgagagcaagtgtttctggcgtggtggttctataaacacacgactgcccttccagaacctgtcgcctagaaccgtgggacagtgtcctaaatacgtcaaccgaagaagcctaatgctggccacaggaatgcgcaacgtgcccgagctaattcagggcaggggcctcttcggcgcaatcgcaggctttctggagaatgggtgggaggggatggtggatggttggtacgggttccgacatcagaacgcccaggggacggggcaggcagccgactacaaatccactcaggccgcaatagaccagattaccgggaaactgaatagactggtggagaaaacaaatactgagttcgagagtattgaatcagagttctccgaaatcgagcatcagatcggcaacgtgattaactggactaaggactctatcacagatatatggacatatcaggccgagctgctggtggccatggagaaccagcacaccatcgacatggccgactcagaaatgttaaacctctatgagcgggttcgtaagcagttacgccaaaacgccgaagaggatggcaaggggtgcttcgaaatttatcacgcttgtgatgattcctgtatggagtccattcggaacaacacctacgaccacagccagtaccgcgaggaggcccttctgaatcgtctgaacataaacccggtcaccctcagttcaggatacaaggacataattctttggttctcctttggcgcctcatgcttcgtgctcctggccgtggtgatggggctctttttcttctgcttgaagaacgggaacatgcggtgtactatctgcatt

SEQ ID NO: 801 - DNA, 1683 bp, Influenza A virus
  misc_feature (1)..(1683): Codon Optimized Sequence Encoding H10 Hemagglutinin
atgtacaaagtggtggtgatcatcgccttactcggggcagtgcgagggctggataagatttgcctgggtcaccacgctgtggcaaacgggacaacagtgaaaactctcacaaatgaacaggaggaagtcaccaacgcaacagagaccgtcgaaagtacctcactcaataagttgtgtatgaaaggtcgccggtacaaggacctcgggaactgccacccaattggaatgctgattggtacgcccgtgtgtgacctgcacctgaccgggacgtgggacaccctgatcgagcgcgagaatgcaactgcttactgctaccccggcgtgaccattaacgaagaagcgctgcgccagaaaatcatggaatcaggggggattagcaaaatgaggacagggttcacatatggtcctagcatcaatagcgccggaacgacacggagctgcatgcgcaacggaggcaactcattttatgccgaacttaagtggctggtgtctgggacaaaggggcagaacttcccacagactactaatacatatcgaaataccgacactgccgagcaccttatcatctggggaatccaccatcctagctcaactcaggaaaagaatgacctctacggtactcagtctctgtccattagcgtgggatccagcacctaccaaaacaattttgttcctgttatcggggcaagaccccaagtgaatggccaatctgggagaatcgaattccactggacactggtcagaccaggcgacaacataactttttcacacaatggaggacttatcgccccagacagggtgtcaaagctgatcggaaagggcatcggaattcagagtggtgcggtgattgataaggattgtgaaagcaagtgcttttggcgcgggggctccattatcaccgagctcccttttcaaaaccttagcccccggacagtcggccaatgcccaaaatatgtcaaaaagcgctcactgctccttgccacggggatgcggaacgtgccggaagtggtgcaaggtcgaggcctctttggcgcgatcgccggattcatcgagaatggttgggaaggcatggtggacgggtggtacgggtttagacaccagaatgcgcagggcattgggcaggctgctgactacaaatcaactcagactgcgattgatcagatcacgggaaaactgaaccgtctcatcgaaaaaacaaacactgagttcgaatccatcgagtcggaatttagtgaaatcgaacaccagatcggcaacgtcattaattggacgaaggactctattacagatatctggacctatcaggctgagctcttggtagcaatggaaaaccaacacactatcgatatggccgatagcgagatgctgaacctgtatgaaagggttagaaagcagctgagacagaacgctgaagaagacggtaagggctgctttgagatctatcatacatgcgacaattcatgtatggagtccatacggaataatacatatgaccattcgcagtaccgagaggaggccttactgaacagactgaacatcaatcctgttaagctgtcaagcggttacaaggacataattctctggttctcctttggtgcctcctgtttcgtacttctcgccgtcatcatggggttgggcttcttttgcctgaaaaatggcaacatgagatgcactatatgcatt

SEQ ID NO: 802 - DNA, 1683 bp, Influenza A virus
  misc_feature (1)..(1683): Codon Optimized Sequence Encoding H10 Hemagglutinin
atgtataagatagtggtaataattgccctcttgggggcagtgaaaggactcgataagatatgcctgggacaccatgccgtggctaacggcacaattgtgaaaacgctaacaaacgagcaggaggaagttaccaacgctaccgaaaccgttgagagtaccggcattaatagactttgtatgaagggccgaaaacacaaagatctcgggaactgtcatccgatcggcatgttgattggaacacctgcatgtgatctccatttaacaggcatgtgggatacattgattgagcgggagaacgctatagcctattgctatcccggagccacagtgaatgttgaggcgcttcgtcagaaaatcatggagagcggaggcatcaacaagatctccaccgggtttacctatggctcgtctataaactcagctggtacaaccagggcttgcatgagaaatgggggaaattccttttatgcagagctgaagtggctggtgtcaaagagcaaaggacagaatttcccgcagaccacaaacacctatcgtaataccgacaccgccgagcaccttattatgtggggcatacaccatccaagctcaacccaggagaagaacgatctgtacggcacgcagagtctgagcatctcagtcggctcttccacttataggaacaacttcgttccagttgtcggggcgcgccctcaagtcaacggacaatctggcaggatcgacttccactggactcttgtacaacccggcgataacatcaccttctcccataacgggggtcttatcgccccatcccgggtgagcaagctcattggtcgcggactggggattcagagcgatgcgcctattgacaataactgcgagagtaaatgcttttggaggggcggtagcatcaacacccggttgcctttccaaaacctttcccctagaacagttggccagtgtccgaagtatgtaaacaggcgaagtctcatgctcgcgacaggcatgcggaatgttcccgagctgattcagggcaggggactgtttggagctatcgcgggatttctggaaaacggttgggaagggatggtggacggatggtatggattccgccaccagaatgcacaaggaacgggccaggccgccgactacaagtccactcaggccgctattgatcagattaccggcaagctcaatcgcctggtggagaagactaataccgagttcgagagcatcgagtccgaattctcggaaattgagcatcagatcggcaatgtcataaattggaccaaagactcaatcacagatatatggacttatcaggctgagttgcttgtggctatggaaaaccagcacacaatcgatatggctgattccgagatgcttaatctgtatgaacgcgtaaggaagcagttacggcaaaatgcagaagaagatggcaagggctgttttgagatctatcatgcctgcgatgacagttgcatggagtcaattaggaataatacgtatgatcactctcagtatcgtgaggaagctctgctgaaccgtctgaacatcaatcctgtgaccttatcgtccggatataaggatatcattctatggttcagctttggcgctagctgctttgtcttactcgctgtggtcatgggcctgttttttttctgcttaaagaacgggaacatgcgttgtacaatctgcatt

SEQ ID NO: 803 - DNA, 1683 bp, Influenza A virus
  misc_feature (1)..(1683): Codon Optimized Sequence Encoding H10 Hemagglutinin
atgtataaaatcgtcgttataatcgcgttattgggagcagtgaagggcttagacaagatttgtctgggacatcatgcagtggtgaacggaaccatcgtgaagacactaacaaatgaacaggaggaagtcaccaacgcaaccgaaactgtggaatctacaggtctaaacaggttgtgtatgaaaggcaggaatcataaagacctcggcaactgccatccaattggtatgcttattggaacgcccgcatgtgacctgcatctcacaggtacatgggacacactcattgagcgcgaaaatgctatcgcctactgctatcctggcgctaccgtcaatgaggaggcactgagacagaagatcatggagagcggcggaataaacaaaatttctacaggcttcacctatgggagcagcatcaattctgccggcacaacaagggcctgtatgcgtaacgggggaaactccttttacgccgagctgaaatggttggtgtccaagagcaaggggcagaactttccccagaccacaaatacatataggaatacggatactgccgagcacctcatcatgtggggcatccatcacccaagctccacccaggagaagaatgacctctacgggacccagtcccttagcatttctgtgggcagtagcacttatcaaaataacttcgtccccgtcgtaggggcgagaccacaggttaacggacaaagcggcagaattgacttccactggacactcgttcagccaggtgataatattacttttagccataatgggggactgatagcacccagcagagtgagtaagttgataggcagggggcttggtattcagtcagatgcgcccattgataacaactgtgagagtaagtgcttctggagagggggctccattaatacccgcttgccatttcaaaacctgtcccccaggactgtagggcagtgccctaagtacgtgaacaaacggtccttaatgctggccactggtatgcgcaatgtgccagagctcatgcagggcagagggctctttggagccatagcagggtttattgaaaatgggtgggagggcatggtggacggatggtacggatttagacaccaaaacgcgcagggcactggacaggcggccgactataagtccacccaggccgcgatcgatcagatcaccggaaagttgaaccgcttaatagagaagacaaacaccgagttcgaaagcatagagtccgaattttccgaaatcgaacaccagatcggcaacgtgatcaactggacgaaggattcgattaccgacatttggacttatcaggctgaactactcgtggctatggagaaccaacatactatcgatatggcagattctgaaatgcttaacctctatgaacgggttaggaaacagctgaggcagaacgcagaagaagacggcaaggggtgcttcgaaatttatcatgcatgtgacgatagttgcatggaaagcattagaaacaacacctatgaccattctcagtatcgggaggaggcactcctgaatcgtctgaatatcaacccagtcacactgagttcagggtataaagacataattctctggttctcattcggagcctcctgttttgtgctactcgcagttgtgatgggactggtctttttttgcctgaaaaatggcaatatgagatgtacaatttgcatc

SEQ ID NO: 804 - DNA, 1683 bp, Influenza A virus
  misc_feature (1)..(1683): Codon Optimized Sequence Encoding H10 Hemagglutinin
atgtataaaattgtggtcataattgcactgctcggcgcagtaaaggggctcgataagatttgcctgggccaccacgccgtcgctaacgggacgattgtcaagaccctgactaacgaacaagaggaggtgactaatgctaccgaaaccgtcgaatccaccggcattaacagactctgtatgaaaggcagaaaacataaggatctgggaaattgccacccaatcggaatgctgatcgggacacccgcctgcgacctgcacctgactgggacttgggatacacttatcgaaagggagaatgccattgcttattgttaccccggcgcaacagcgaatgttgaagccctgcggcaaaaaattatggaatccggtggcattgacaagatcagcaccgggttcacctacggctcatctattaacagtgctgggaccaccagagcttgcatgcggaacggtggcaacagtttctacgctgaactcaagtggttagtctcaaagtctaaaggacagaacttcccccagactactaatacgtataggaacactgatactgctgaacatctgattatgtggggcattcaccatccaagctcaattcaggagaaaaacgacctgtatggcacccagtcgctgtctatcagcgtgggttccagcacctaccggaacaattttgtaccggtggttggcgcgcgtcctcaggtcaatggtcaatctgggcggattgacttccactggactctggttcaacccggcgacaacataactttctctcacaatggtggattgatcgctccttcccgcgtttcaaaactgataggccgcggcttaggaattcagagcgacgccccgatagacaataattgcgagtccaagtgcttctggaggggaggaagcattaacacgcggttgcctttccagaacctgtccccaaggacagtgggacaatgcccaaaatatgtcaatagaagaagtctcatgctggcgactggtatgcgcaacgtgcctgagcttatccagggccgcggattgttcggggcaatcgccggcttcctggaaaatgggtgggaaggaatggtggatggttggtacggttttcgacatcagaatgcccagggtactggccaggctgcagactataaaagcactcaggctgccattgaccagatcacgggtaaactgaataggctggtggagaagacgaacacagagttcgagtctattgaatctgagttttctgagatagagcaccagatcggaaacgtcatcaactggaccatggattccataactgacatctggacttaccaggcggaactgctggttgcaatggagaatcagcacactattgacatggccgattccgagatgctcaatctttacgagcgggtccgtaaacagctaaggcagaatgccgaggaagatgggaagggttgcttcgaaatatatcatgcatgtgatgattcttgtatggagtcgattcgtaataacacctacgatcacagtcaatacagagaagaagctcttcttaatcggctaaacattaacccagtcacattgagctcaggatacaaggacatcatcctgtggttctcattcggggcttcctgttttgtcctgctggccgtggtcatggggctggtttttttttgcctgaagaacggcaatatgagatgcacaatttgcatc

SEQ ID NO: 805 - DNA, 1683 bp, Influenza A virus
  misc_feature (1)..(1683): Codon Optimized Sequence Encoding H10 Hemagglutinin
atgtataaggtggttgtgattattgcgctgctcggggccgttcgaggcctggataaaatctgtctgggccatcacgctgtcgccaatggcacgactgtgaaaactttaacaaatgagcaggaagaggtgacaaatgccactgaaaccgtcgagagtacatcactgaataaactgtgcatgaagggacgccgctataaggacctgggtaattgccatccaattggtatgttgatcgggacccctgtgtgcgacttacacctaactggcacttgggacacactgatcgagagggagaatgccaccgcctattgttaccctggtgtgaccattaacgaagaggctctcagacaaaagattatggagtctggaggaatctctaagatgcgtactgggtttacctatgggccaagcatcaactcggctggcactactcgctcctgtatgagaaatggaggaaactccttttatgctgagttgaagtggctcgtttccggcaccaaggggcaaaactttccacagacgaccaatacttataggaatacggacaccgctgaacacctgattatttggggaatccatcaccccagctctacgcaggagaagaacgacctttacggtacccagagtctttcgattagcgtgggcagcagcacataccagaataatttcgtgcccgtaataggtgcacggcctcaggtgaatggacagtcgggccggatagaattccactggacgctcgttaggcccggagacaacataactttttctcataatggcggacttatcgctccagatcgggtcagcaagcttatagggaaggggatcggcatccagtccggtgctgtcatcgataaggactgtgaatccaagtgtttctggcgtggcggttcaattatcaccgaactaccttttcaaaacttgtcaccaagaaccgtgggacagtgtccaaagtatgtcaaaaaaagatccttgttactggctaccgggatgaggaatgtgcctgaagtcgttcagggccgcgggctgttcggagccatcgcgggatttatcgaaaacgggtgggaggggatggtggacggttggtacggattcaggcatcagaatgctcaggggattgggcaggctgccgactacaagtctacccagacggctattgaccagatcaccggcaagttgaatcgcctgatagaaaaaactaatacggaattcgaaagcatcgaatccgagttctcagaaatcgagcaccagataggtaatgtaatcaattggacaaaggactctatcaccgatatctggacctatcaggcagaattgctggtggcaatggagaaccagcacacaatcgatatggctgattcagaaatgctgaatttgtacgagagggtccggaagcagctccgacagaacgcagaagaagatgggaagggttgtttcgagatatatcatacctgcgacaactcgtgtatggaatcaatacgcaataatacatacgatcacagtcagtatcgtgaggaggctctcctgaacaggctgaatattaatcctgtgaaactgagctccgggtacaaggatattattctgtggttcagttttggcgcttcatgtttcgtgttgctggcagttattatggggcttggtttcttctgcctgaagaatgggaacatgcgctgcacgatttgcata

SEQ ID NO: 806 - DNA, 1683 bp, Influenza A virus
  misc_feature (1)..(1683): Codon Optimized Sequence Encoding H10 Hemagglutinin
atgtataaggtggtcgtaatcatcgcccttctgggtgctgtccggggcttggacaaaatttgtctcgggcatcacgcagtggctaacggcacaatagtgaagaccctcactaacgaacaggaggaagtgacaaacgcgacagaaacagttgagagtaaatccctcggcaagctgtgcatgaaagggaggagttataatgacctcggcaattgtcatccgataggtattctgatcggcactcctgcgtgcgacctgcacctgaccgggacctgggataccctcatcgagagggagaacgccgtggcctactgctacccaggcgccacagtaaatgaggaagcgctgcggcagaaaattatggaatctggaggaattagcaagatttctactggcttcacctatgggacaagcatcaacagcgccggtaccacgaaggcctgtatgagaaacggtgggaattctttttacgcagagctcaaatggctggtgagcaaaaacaaggggcaaaatttcccccagaccacaaacacatataggaatacagacacagctgagcatttaattatttggggcatccatcacccctccagcacacaagaaaagaatgacctgtacggtacccagtctctctctattagcgttggctcttctacataccagaataactttgttccagtcgtcggagcacggccacaggttaacgggcagagtggacgtatcgatttccactggactcttctacagcctggcgacaatattacttttagtcacaacggcggccttatagccccgtccagagtctccaagctgatcggcagagggctgggcattcagtccgaggctccaattgataatggctgcgaaagcaaatgcttttggaaaggcgggagtatcaacacaaaactgccctttcagaatctgagccctcgaactgtgggtcagtgcccaaaatacgttaataagcggagtctgatgttagctactggcatgcggaacgttccagaaatcatgcacggccgcggactctttggagctatcgccgggtttatagaaaatggctgggaaggcatggttgacggctggtacggattcaggcaccaaaacgcccagggaaccggacaggccgccgattacaaaagcacgcaagcagctattgatcagatcactggaaaactcaatcgactgatcgaaaagactaacacagaatttgaatccattgagtccgaatttagtgagatcgagcaccaaatcggcaacatcattaactggacgaaggacagcataacagacatatggacatatcaggcagagctcctggtcgcaatggaaaaccagcataccatagatatggctgattctgagatgctcaatctgtatgaacgagtcagaaagcaattaagacaaaacgctgaggaggatggtaagggatgcttcgagatttaccatgcttgcgacgattcctgcatggaaagcatccgtaataacacctacgaccacagccaataccgtgaagaagccctcctaaatcgattgaacattaatcctgtgaaattgagttccggctacaaggacatcatcctgtggttctcatttggcgcatcatgcttgattcttttggccgtggtgatgggcctggttttcttctgtctgaaaaatggcaacatgagatgtactatctgcatt

SEQ ID NO: 807 - DNA, 1683 bp, Influenza A virus
  misc_feature (1)..(1683): Codon Optimized Sequence Encoding H10 Hemagglutinin
atgtacaagatcgtggttataattgccctcctgggcgccgttaagggccttgataagatatgtctggggcaccatgccgtggctaatgggaccatagtgaaaaccctgactaatgagcaggaggaggtcactaacgccaccgagactgtggaatccaccggcatcaacaggctgtgtatgaaggggcgcaaacacaaggacctagggaattgccaccccatcggtatgcttatcggcacgccagcctgtgaccttcacctgactgggatgtgggacactctgattgaaagagaaaacgctatagcgtactgctaccccggcgcaactgtgaacgtagaagcgttgcggcagaagatcatggagtctgggggaatcaataagatctcaacagggtttacatacggctcatctatcaattccgcgggcacgaccagggcgtgcatgaggaacggcgggaactctttttacgccgagcttaaatggttagtatctaagagcaaggggcagaactttccacaaacgaccaacacataccgcaacaccgataccgcagaacacctcatcatgtggggaatccaccatcccagttccactcaagaaaaaaacgatctatacggcactcagtccctctcaatctccgtgggaagtagcacatatcggaacaacttcgtgcccgtggttggggcccgcccccaggtcaatggccagtcaggaagaattgacttccattggacacttgtgcagccaggcgacaatatcacattttcccacaacggcggattgatcgccccctccagagttagcaagctgatcgggagaggcctgggtatccagagtgacgcgccaatcgataacaactgcgagagcaagtgcttttggcgcggaggctcaattaacacacggctacctttccaaaacctcagtccgcgtacagttggccagtgccccaagtatgtgaaccggagatctttgatgctcgctaccggcatgcgaaatgtcccggagctgattcaaggccgcgggctctttggagcgattgcggggtttctggagaacggatgggaaggaatggtggatggttggtacggatttcggcatcaaaatgcacaggggactggccaagccgcagactataagagcacccaggctgcgatcgaccagatcaccggaaagctcaaccgcctggtggagaagaccaatacggaatttgaatcaatcgaaagcgagtttagtgaaatagaacaccagattggtaatgtgattaattggacaaaagacagcattactgatatttggacatatcaggctgagttactggtagctatggagaatcagcacaccattgatatggccgactccgaaatgctgaatctgtacgaacgggttcggaaacagctcaggcagaacgccgaagaagacggtaagggatgcttcgaaatctaccacgcctgcgatgatagttgcatggagtctatacggaacaacacctatgaccattctcagtatagagaagaggccctactgaaccgtttgaacattaatccagtgaccctgtcctccggttacaaggacataatcctgtggttctcgtttggtgctagctgctttgtgctgctggcggtggtaatgggactgtttttcttttgcctgaaaaatggcaatatgagatgcaccatttgcatc

SEQ ID NO: 808 - DNA, 1683 bp, Influenza A virus
  misc_feature (1)..(1683): Codon Optimized Sequence Encoding H10 Hemagglutinin
atgtacaagattgtggtgattatagcccttctgggggctgtcaagggactggacaaaatctgcctgggacatcatgctgtggcaaacggaactattgtgaagactttgactaacgaacaggaggaggtgaccaacgccaccgaaaccgtggaatccacaggcatcaaccggctctgcatgaaaggaagaaagcacaaggacctgggcaattgtcatccaatcggaatgcttatcgggactccggcctgtgatttgcatctgaccggcatgtgggatacgttaatcgaacgagagaacgccattgcctattgctaccctggcgcgaccgtgaatgtcgaggccttgaggcagaagatcatggagagcggcggaatcaacaaaataagcactggtttcacctacggtagtagcataaattccgctgggaccacgcgggcctgcatgcggaacggcggcaattccttttacgcagagcttaaatggttagtgagcaaaagcaagggacagaatttcccccagaccacaaacacatatcgtaacaccgacaccgcggaacatctgattatgtggggcatacatcacccctcttccacgcaagaaaagaatgacctgtacggaacacaatccttatccattagcgtaggaagcagcacttatcggaacaactttgtgcccgtggtgggagctcggcctcaggtaaacggccagtccggtcggatagatttccattggactttggttcagccgggggataacattacattttcccataacggcggcctcattgctccctcgcgggtctctaaacttattgggcggggcctggggatccagtcagatgcccctatcgataataattgcgaatccaaatgtttttggagaggaggcagtattaacacccggctgcctttccagaatctcagcccccgtacagtcggacagtgtcccaaatatgtgaatagacgctcgctaatgctggccaccggcatgcggaacgttcctgagctgatccagggacgggggctctttggtgcaattgctggatttctggaaaatggctgggaaggcatggtggatggctggtacggctttaggcaccagaatgcccaaggcacggggcaggcagccgactacaaatccacacaagccgccattgaccaaatcaccgggaaattaaataggcttgtggagaaaaccaataccgaattcgaaagcatcgagagcgaattttcagagatcgagcaccagatcgggaatgtgataaattggaccaaagattccattaccgatatttggacttaccaagctgagctgctcgtggccatggaaaaccagcacacaatcgatatggccgactctgaaatgttgaacttgtatgaaagagtgcgaaaacagttgcgtcaaaacgccgaggaagacgggaaaggttgtttcgaaatctatcacgcgtgcgatgacagctgtatggaaagtattaggaacaatacatatgaccactcacagtatcgcgaggaggcactgttgaatcgcctaaacatcaaccccgttacattgtcttctggttacaaagacattatcttatggttttcgtttggagcctcgtgtttcgtgctcctagcggtagtgatggggctcttcttcttctgtctgaagaacgggaacatgcgctgcactatctgtatc

SEQ ID NO: 809 - DNA, 1683 bp, Influenza A virus
  misc_feature (1)..(1683): Codon Optimized Sequence Encoding H10 Hemagglutinin
atgtacaagatcgtagtcatcatcgccctgctgggggccgtcaaaggactggacaagatttgcctgggccatcatgcagtcgcaaatggcactatcgtgaagactctgacaaacgaacaggaagaggtgacaaatgccactgaaacagtcgagtctactgggatcaacagactttgcatgaagggccgcaagcacaaggacctgggtaattgccaccccattggaatgcttattggcacacccgcttgcgacttacacctaaccggtatgtgggatactctgatcgaaagggaaaacgccattgcatactgctaccccggcgctacagtgaacgtcgaggctctgcgccagaaaattatggagtctggtggaatcaataagatctcaactggcttcacctatgggagttccatcaacagcgctgggactacgcgtgcgtgcatgcgtaacggcggaaacagcttttacgcagagctgaaatggctcgtcagcaagtccaagggtcagaatttcccacagactacgaatacctaccgaaatactgacactgcggagcatctcatcatgtggggaatccaccatccaagcagcacccaggaaaagaacgatctgtacggcactcagtccctaagcatctccgtcggcagcagtacttatcgcaataactttgtccccgtggtaggagcccgtcctcaggtgaacggacagagcggacgtatcgactttcattggacactcgtgcaacccggggacaatataacgttcagccataacggaggtttaatagcgcctagccgtgtgtccaaactcatcggccgtggcctggggatccaatccgatgcaccaatcgacaataactgcgagtctaagtgcttctggcggggaggctcaattaatacccgcctacccttccagaatctgtcacccaggaccgtgggccagtgtcctaagtacgtcaacaggcgatctctcatgttggccactggcatgcgaaacgtgcctgagctgatccaaggtagagggctgttcggagcaatcgccggattcctggagaacggctgggagggaatggtggacggatggtatggtttcaggcaccaaaacgctcaaggaactggccaggcagctgactataagtccactcaggctgcaatcgatcaaatcaccggcaagctgaacaggctcgttgagaaaacgaacacggaatttgagtccatcgaatctgaattttccgagatcgaacatcagataggcaacgttatcaactggacgaaggactctatcactgacatttggacgtatcaggcggagctcttagtggccatggaaaaccagcacactatcgacatggccgacagtgaaatgctgaacctctacgaaagagttcgcaagcagctccggcagaatgcagaagaggatggaaaaggctgttttgaaatctaccacgcatgtgacgactcatgcatggagtctatacgaaataatacttacgaccattcgcaatatcgcgaggaggctctgctaaataggttgaacatcaatcccgtcacactgtccagtggctacaaggatatcattctgtggttctcatttggagcctcctgcttcgttctgctggccgtggttatgggattattcttcttttgcctcaagaacggaaatatgcgctgcacaatctgcatc

SEQ ID NO: 810 - DNA, 1683 bp, Influenza A virus
  misc_feature (1)..(1683): Codon Optimized Sequence Encoding H10 Hemagglutinin
atgtacaagattgtggtgattatcgcattgctgggcgccgtgaaggggctggataaaatatgtctggggcaccatgccgtagcaaacggtacgatagttaagactcttaccaacgaacaggaagaggtgacgaacgcgacagagaccgttgagagtacaggtattaatcgactctgtatgaagggccgcaagcacaaggacctgggcaattgccaccccatcgggatgctgatcggcactcctgcgtgtgatctgcacttgaccggcacttgggacactttgattgagagagaaaacgcgattgcttattgctaccctggagcaaccgccaatgttgaagccctgaggcagaagattatggagtcgggaggtattgataagatctccactggattcacttacggctcatctataaatagcgccgggactacccgcgcttgcatgaggaacggggggaacagcttctatgccgagctcaaatggcttgtgtctaagtcgaaaggtcaaaacttcccacagacaactaacacataccgcaacaccgacactgcagagcacttgattatgtggggcatccatcatccgtctagcatccaggagaagaatgatctctatgggacccagagcctcagcatttcagtcggaagttccacctacaggaataatttcgtgcctgtggtgggcgcacggcctcaagtgaacggccagtccggaagaatagactttcactggactctggtgcagccgggggataacattacattctcgcacaacggtgggcttatagcccccagcagagtaagtaaacttatcggtcggggtttgggcattcagtcggatgcccctatcgataataattgtgaatctaaatgtttttggaggggcgggagcatcaacaccaggctgcctttccagaatctgtccccccgaactgtgggacagtgccccaagtatgttaacagacggtcccttatgctggccactggcatgcgcaacgtccccgaactcattcaggggcgcggtctgtttggtgcaattgccgggtttctggagaacggctgggaagggatggtagacggttggtatggcttccggcaccaaaacgcccagggaactggccaagctgccgactacaaatctacccaggctgccatagatcagatcactggcaaactcaatcgcctggtggaaaaaaccaacacagagtttgagagcatcgagtccgaattctccgaaatcgaacaccagatcggtaatgtgattaactggaccatggatagtatcaccgacatatggacatatcaggctgaactcctggtggccatggagaaccaacatactattgatatggccgactcagaaatgttaaatctgtatgagcgtgtgagaaaacagctcaggcagaacgctgaggaagacggaaagggctgcttcgaaatctaccacgcatgcgatgactcttgcatggaatcaatccggaacaacacatatgaccacagccagtaccgggaggaggcccttttgaataggctgaatatcaatcccgtcacgctttcttccggttacaaagatataattctgtggttctcattcggggcaagctgctttgtgcttctcgctgtcgtgatgggcctcgttttcttttgcttgaagaatggaaatatgcggtgcacgatctgtatc

SEQ ID NO: 811 - DNA, 1683 bp, Influenza A virus
  misc_feature (1)..(1683): Codon Optimized Sequence Encoding H10 Hemagglutinin
atgtacaagatcatcgttataatcgcactcctgggcgccgtcaaaggcctggacaagatttgcctagggcatcacgccgtagccaatggaaccattgtcaagaccctgaccaacgagcaggaagaggtgacaaacgccacagagacagtagagtccaccggaatcaatcgcttgtgcatgaaaggacggaagcataaagacttaggaaattgtcatccaatcggcatgctgattgggacacccgcctgtgacttgcatttgacagggacctgggacacccttatcgagcgtgagaatgccatcgcgtactgctaccccggggctacggtgaacgtcgaggctttaagacagaagatcatggagtccggcggaatcgataagatttctaccggtttcacttacgggagttctatcaactctgcaggaaccactcgggcctgcatgaggaatggaggcaactcattctacgcagaattgaaatggctggtaagcaagagcaagggccaaaatttcccccagaccacgaatacctataggaatactgacactgcggagcatctgattatgtggggcatccaccacccgagctcaactcaagagaaaaatgatctttacggaacccagagcctgtcaatttccgtggggagcagtacttatcgcaataatttcgtacctgtcgtaggtgccagaccgcaggtcaatggacagagcggccgtatcgacttccactggacactggtgcagccaggggataacatcactttttcccacaacggcggcctgatcgctcccagcagggtgtcgaagctgatcggtcgggggctggggatacagtcagacgcacccattgataacaattgcgagagcaaatgtttctggcgtggtggaagcataaacacaagacttccgtttcagaaccttagtccacgcactgtcggccagtgcccaaaatacgtaaaccgacgttccctgatgctcgctacggggatgcgaaacgtaccagagttaatccagggccgcgggctgttcggagctattgccggcttcctcgaaaacgggtgggaaggcatggtagacgggtggtacgggtttaggcatcaaaacgcccagggcacaggccaggcggccgactataaaagcacccaggctgcaattgaccagattaccgggaaactgaacagacttgtagaaaaaaccaatacagaatttgagtctatcgaatcagagttctctgagatagagcatcagatcggtaacgtgatcaattggactaaagattcaataactgacatatggacttaccaggccgaacttctggtggctatggaaaaccagcatacaattgacatggccgactccgagatgttgaacctttacgagcgcgtgcgtaaacagctgaggcaaaatgctgaagaagacggaaaaggctgcttcgagatatatcacgcttgtgacgattcatgtatggaatccatacggaataatacttacgaccattcgcaatatagggaggaggccttgttgaaccggctgaatatcaatccagtgacccttagctccggctataaagatattattttgtggttctcttttggagcttcctgctttgtcctattagctgtggtcatgggcctcttttttttctgccttaaaaatgggaatatgcggtgcactatctgtatc

SEQ ID NO: 812 - DNA, 1683 bp, Influenza A virus
  misc_feature (1)..(1683): Codon Optimized Sequence Encoding H10 Hemagglutinin
atgtataagatcgtggtgataatcgccctgctgggggctgttaaaggtctcgacaaaatctgcttagggcatcacgccgtggccaatggcaccatagttaagaccctgaccaatgaacaggaagaggttaccaacgcaacggagaccgtcgaatctaccggcatcaaccgattatgcatgaagggtcgcaagcacaaagatctcggaaactgccaccccattggcatgctcatcgggacccctgcttgcgacctgcatttaacaggtatgtgggacacgctgattgaaagagagaacgcgatcgcctactgttacccaggcgctacagtgaacgtggaggctctgcgacagaaaattatggagtcgggcggcatcaataaaatcagcacgggtttcacttatggcagttcaatcaactccgccggtactaccagggcctgtatgcggaatgggggcaactctttttatgccgagctgaagtggctggtctccaagagtaagggccagaatttcccacagaccacaaacacttacaggaacacggacaccgccgagcatctgattatgtggggcattcaccacccatctagtacccaggagaagaacgacttgtacggcacacagtctctgtcaattagtgttgggtcttccacatatcgtaataattttgtaccggtcgtgggcgcggggccccaagtgaacggtcaaagcggtaggattgattttcattggaccctcgtgcaaccaggagataatatcactttttcgcacaatggcggtctcatagccccgagccgggtcagcaagctaatcggacgggggctcgggatccagtccgatgctcccatcgataataactgtgaatctaagtgtttttggcggggcggatccataaacaccaggcttcccttccagaacttgtccccaaggacggtaggccaatgcccaaagtacgttaaccgccgctcactcatgttggccactgggatgagaaacgtcccggaactgattcagggccggggcctgtttggcgcaatcgctgggttcttagagaacggctgggagggcatggtggacggatggtacgggttccgccatcagaacgctcaaggcactgggcaggctgcagattacaagagtacccaggctgccattgatcagattaccggaaaactgaataggctggtcgaaaagacaaacactgagttcgaaagcatcgagagcgaattttctgagatcgagcaccagatcgggaatgtgattaactggactaaagatagcataacggatatttggacatatcaagcagagttgttggtggccatggagaatcagcatacaatcgacatggccgatagtgaaatgctgaatctttatgaaagggtacggaagcagctgcgccaaaacgccgaggaagatgggaaggggtgttttgaaatctatcatgcctgtgacgattcctgcatggaatctattcgtaataatacttacgaccatagccaatatcgagaggaggcattgttgaacaggctaaacatcaatccggtgacactcagttccggatataaagatataatcctctggttctcttttggcgcttcttgtttcgtgctgcttgctgtcgtaatgggactgttctttttttgtctcaaaaacggcaacatgagatgcaccatttgcata

SEQ ID NO: 813 - DNA, 1683 bp, Influenza A virus
  misc_feature (1)..(1683): Codon Optimized Sequence Encoding H10 Hemagglutinin
atgtataaaatcgttgtgatcattgccctgctgggcgccgtaaagggcctggacaaaatatgcctggggcaccatgcagtagtgaatggcacaattgtcaagacactcactaacgaacaggaagaagtcaccaatgccacggagacggtggagagtaccggtctgaaccgtctgtgcatgaagggccgcaaccataaagacttgggtaactgtcatcctataggtatgctaatcggtactccggcctgcgatctgcacctcaccggtacctgggacaccctgatcgagcgtgagaacgcgatcgcctattgctatccaggcgctactgtaaatgaggaagccctgagacagaagatcatggagtccggagggatcaataagatctctactggattcacctatggcagcagtattaactccgccggaactacgcgggcctgcatgagaaatggcgggaatagcttctacgctgaactgaaatggctcgtttcgaagtcaaaaggacagaacttccctcagacaacgaacacataccgcaacaccgacaccgcggagcatctaatcatgtggggtatccatcaccccagctctacacaggaaaaaaatgatctttatggaacccagtctttgtccatttctgtgggcagctccacctaccagaacaatttcgtcccagtcgtgggcgcgcggccacaggtgaacggacagtcggggcgcattgactttcactggaccctggtgcagcccggtgacaatatcactttttctcacaacggcggacttattgctccctcccgggtgagcaaactgatcgggcgggggctggggatccagtccgatgcacctatcgataacaattgcgagagtaaatgcttctggcgtgggggatcaataaataccaggctcccattccaaaatctttcaccccgtacagttggacagtgccccaaatacgtgaacaagcgctctcttatgctggcaacaggaatgagaaacgttccagagctaatgcagggtcgagggcttttcggagctattgctggatttatcgaaaatggctgggagggaatggtcgatggatggtatggattccgacaccagaacgctcaggggaccggccaggccgcggactacaagagcacacaggctgcaattgatcagatcacagggaagttaaataggctcatcgaaaagacgaacaccgagttcgagtcaatcgagtccgaattctctgagatcgaacaccaaattggcaatgtcatcaattggacaaaggatagtatcaccgatatttggacgtaccaagcagagcttctggttgccatggagaaccaacacaccatcgatatggccgacagcgagatgcttaatctgtacgagcgcgtgcgaaagcaacttaggcaaaacgccgaagaagatggtaagggctgctttgagatttatcacgcttgcgatgactcctgcatggagtctattagaaataatacctacgatcattctcagtatagagaggaggccctgctgaaccggttgaacattaacccagttacactgagctccggatacaaagatattattctgtggttttcctttggcgcgtcctgctttgtgctgttagccgtggtgatggggctggtattcttctgtctcaagaacggtaatatgcgttgtaccatatgcatc

SEQ ID NO: 814 - DNA, 1683 bp, Influenza A virus
  misc_feature (1)..(1683): Codon Optimized Sequence Encoding H10 Hemagglutinin
atgtataagatcgtggtcataattgcactcttgggggcagtgaaagggctggataaaatttgtctgggacaccacgccgttgctaatggcaccatcgtgaaaacccttaccaacgagcaggaagaggttactaacgcaaccgagacggtcgagtccactggaatcaatcgtctttgcatgaagggccgtaaacataaggatttaggaaattgtcatcccattggcatgctgatcggaacacctgcctgcgacctgcacctgacagggatgtgggacacgctgatcgagagggagaatgcaattgcgtactgttatcctggagctaccgtgaatgttgaagcactgcgtcaaaaaatcatggaatccggcgggatcaacaaaattagcactgggttcacatatggaagcagcataaactccgccggcactacaagggcctgcatgagaaacggcggcaatagtttctacgctgaacttaagtggcttgtgtcaaaatcaaaggggcaaaactttcctcagactacaaatacatatagaaacactgacaccgccgagcacctgatcatgtggggcattcaccatcctagctctacccaggagaaaaatgatttatacggcactcagagtctgtctatttctgtggggtcgtccacatatagaaataatttcgtgccagtcgtgggggctcggccgcaagtgaatgggcagagtggtagaatcgatttccactggacacttgtgcagcccggggataacattactttctctcataacggcggcctgatcgcaccctccagggtgagtaaactaataggcaggggtctgggcattcagtccgacgctccaatcgataacaactgcgagtccaagtgcttctggcgcggcggttccatcaacacccggttaccttttcagaacctgtccccccgcaccgttggccagtgccctaaatacgtaaatcgaagatcattaatgctggcgaccggtatgaggaacgtacctgagctgattcaggggagggggttatttggtgccattgccgggtttctcgaaaacgggtgggagggaatggttgatggctggtacgggttcaggcaccagaatgcccagggcacaggacaggctgccgattacaagagcactcaggccgctattgaccagatcaccggcaagctgaatcggctggtagagaaaaccaatacggagtttgagtccattgagtccgagttctcagagatcgagcaccagattggcaatgtcatcaattggaccaaggattcaattacggatatatggacataccaggctgagctgcttgtagcaatggagaaccaacataccatagacatggctgattctgagatgctgaacctctacgaaagggtcagaaaacaactcagacaaaacgcagaagaagacgggaaagggtgtttcgaaatttaccatgcttgtgatgactcctgcatggagagcatcagaaacaacacttatgaccacagccagtaccgtgaagaggcattgttgaaccgactcaacatcaaccctgttacgctgtcatctgggtataaagacattattctatggttctcttttggcgcttcatgttttgttctgttggcggtagtgatgggtctgttctttttctgtttaaaaaatggcaatatgaggtgcaccatctgcata

SEQ ID NO: 815 - DNA, 1683 bp, Influenza A virus
  misc_feature (1)..(1683): Codon Optimized Sequence Encoding H10 Hemagglutinin
atgtacaagatcgtggttattatcgctcttctgggtgccgttaaagggctggacaaaatttgtctggggcatcacgccgtggcgaatggtactatcgtcaagacattgaccaacgagcaggaggaggttacaaatgcaaccgagaccgttgagagtactggaatcaaccggctgtgcatgaagggaagaaagcacaaggatctggggaattgtcaccctatcggaatgttaattggtacacctgcttgtgacctgcacctgacaggcatgtgggacaccctgatcgaacgggagaacgccattgcctattgttatccaggggccactgttaatgtcgaggcactcaggcagaagattatggaatccggtggaattaataaaattagcacagggtttacttacggttcctcaataaattcagccggcactacacgggcgtgtatgaggaatggaggaaactccttctatgccgaactgaaatggctcgtcagcaaatccaagggtcaaaattttcctcaaacaactaacacctatagaaataccgataccgcagagcacctcataatgtgggggatacaccatccgagctccacacaagaaaaaaacgacctgtatggcactcaaagtcttagcatttccgtcggaagttctacataccggaataactttgtgccggtggtaggtgcccgaccccaagtcaacggccagagtggccgcatcgatttccattggacactggtgcagccaggagataacattaccttttctcacaatggcggcttgatcgctccttcgagggtgagcaagctgattggccggggtctgggcattcaatccgacgcgcctatcgacaataattgtgagtctaaatgcttttggagaggagggtcaatcaacacaagactacccttccagaatctttccccccgaacagtgggacagtgccccaaatatgtgaatcggcgctctcttatgctggccactgggatgagaaacgtgcctgagttaatacagggccggggacttttcggagcaatcgccggattcctagagaacggttgggaggggatggtcgacggatggtacgggttcagacaccaaaatgctcaggggacagggcaggcagcagactataaatcaacgcaggccgctatcgaccagatcaccggtaaactgaaccggcttgtcgaaaagaccaacactgagttcgagagtattgaatccgagtttagcgagatcgaacaccagataggcaatgttatcaattggacaaaggattcaatcacggacatatggacataccaagcagaactgctggtagctatggaaaatcaacatacaatcgatatggccgactcagagatgctcaacctctacgaaagagtaaggaaacaactcagacaaaatgccgaagaggacggcaagggttgctttgaaatatatcatgcgtgcgacgacagctgcatggagagcatacggaacaatacgtacgaccattcccagtatcgcgaagaagccttactgaaccgcttgaacattaaccccgtgaccctttcctccggatataaagatatcattctctggttcagttttggagcctcatgctttgtccttttggctgtggtaatgggattatttttcttctgtctcaagaatggtaacatgcgatgtacaatttgcatc

SEQ ID NO: 816 - DNA, 1683 bp, Influenza A virus
  misc_feature (1)..(1683): Codon Optimized Sequence Encoding H10 Hemagglutinin
atgtacaagatcgtggtgatcatagcactgctgggcgccgtgaaaggcttagacaaaatctgcttagggcatcatgccgtcgctaatgggactatagtcaagacattgaccaacgagcaagaagaggtgacaaacgcaactgaaactgttgaaagtaccgggataaaccggttgtgcatgaaagggcgaaagcacaaggaccttggcaactgtcatcccatcggcatgcttataggaacacctgcttgcgatctccatctgactggcatgtgggacaccctgatagaacgagaaaatgccattgcctactgttacccaggcgccaccgttaatgttgaggccctcagacagaagataatggaatctggaggcatcaacaaaatctctacgggctttacctacggttctagcattaactctgccgggactacccgagcttgtatgcgcaacgggggcaactctttctacgccgaacttaagtggctggtgagcaagagcaagggacagaatttccctcaaactactaacacttataggaacacagacaccgccgaacatctaataatgtggggaatacaccatccctcatccacacaggaaaaaaacgacctttatgggacccagtctctgagcatttcagtcggctcatccacttatcgtaacaactttgtgcccgtggttggggctcggccccaggtgaatggccagtctgggcgtattgatttccactggaccctagtgcaacccggagacaacatcacctttagtcataatggtggccttatagcccctagcagggtgtcaaaacttattgggagaggcctcgggattcagagtgacgcacccatcgacaacaactgcgagagtaagtgtttttggagagggggttcgatcaacacccgcctccccttccagaacctatcgccacgcactgttggtcagtgcccaaaatacgtcaacaggaggtcacttatgctggctacagggatgcggaacgtgccggagctgatacagggacgcggtctgttcggagccattgccggattcttggagaatggctgggaggggatggtggacggctggtacggcttccgacaccagaatgcccagggtacaggtcaggcagcggactataagagtactcaagccgctatcgatcaaatcactgggaagctcaaccgactggtcgagaagacaaacacagaattcgagtctatcgagtcagaattctctgaaatcgagcaccagattggtaacgtaatcaattggaccaaggatagtattaccgacatctggacataccaagcagaactgctcgtggcaatggaaaatcagcacacaatagacatggccgatagtgagatgctcaacctgtacgaacgcgttcgaaaacagctgagacagaacgctgaagaagacgggaaagggtgcttcgagatctatcacgcctgcgacgattcatgcatggagagcattagaaacaatacctacgaccacagccagtatagggaggaggctctgctaaacaggctcaacattaatcccgtaacactctcaagcggatataaagacataattctgtggttttccttcggagcttcctgcttcgtcctgctggcggtagtcatggggttattctttttttgtctgaagaacgggaatatgcgatgtacaatatgcatt

SEQ ID NO: 817 - DNA, 1683 bp, Influenza A virus
  misc_feature (1)..(1683): Codon Optimized Sequence Encoding H10 Hemagglutinin
atgtacaaggttgtggttattatagcactcctcggggctgtgcgcggactggataagatctgcctgggacatcatgccgtggcaaatggtaccactgtaaaaactctcaccaatgagcaggaagaggtgaccaacgccactgagacagtggaatctacaagcctgaacaagctgtgtatgaagggcagacgatataaggatctgggtaattgccatcccatcggcatgttgatcggaacaccagtttgcgatctgcatctaactggaacctgggacacgcttatcgagcgggaaaacgccaccgcgtactgctacccaggagtcaccatcaacgaagaagcactgagacagaagatcatggagagtggggggatctccaagatgcgcaccgggttcacttatgggcccagcattaacagcgctgggacaaccagatcctgcatgaggaatggagggaactctttttatgccgaattaaaatggctggtttcaggaacaaaaggacaaaatttcccgcagaccaccaatacatatagaaacaccgatacagcagaacacttaatcatctgggggatccatcacccttcatctacgcaggaaaagaatgatctgtatggtacccagtctttgagtattagtgtaggctcttccacgtaccagaataactttgtccctgttataggtgctcgacctcaggtcaatgggcagtctgggcgtatcgagttccattggaccctcgtacgacccggcgacaacatcacatttagccacaacggcggattgatagcccccgacagagtgtccaagttaatcggcaaaggaattggtatccagtccggcgccgtgatcgataaggattgtgagtcaaaatgcttctggagaggcggcagcatcataacagagcttccgtttcaaaacctgagtccccgcaccgttgggcaatgtcctaagtacgtgaaaaaacgaagcctcctgctggcaaccggcatgcggaatgttcccgaggtggtccagggaagaggcctgtttggcgcgattgctgggttcatcgagaatggctgggaaggcatggttgacggatggtatgggttcaggcatcagaacgcgcagggcatcgggcaggctgctgactacaagagcactcagaccgccatcgatcagatcacagggaagctaaatcggctgattgaaaagactaacacggagtttgagagcattgaaagcgaatttagtgaaatcgaacaccagataggaaacgttattaactggacaaaggatagtattaccgacatatggacgtatcaagcagagctgctggtcgccatggagaaccagcatactatagatatggcagacagcgaaatgctcaatttgtacgagagggtaagaaaacaactgagacaaaatgctgaagaggatggcaaaggctgctttgaaatataccacacctgtgacaattcctgtatggagtccattcggaacaatacgtatgatcattcccagtatcgcgaggaagccctactcaaccgcctcaatatcaaccccgttaagctatcatcaggctacaaggacattatcctgtggttcagcttcggagcctcctgtttcgtgctacttgctgtgatcatgggtttggggttcttttgcctgaaaaatggaaatatgagatgcacaatttgtatt

SEQ ID NO: 818 - DNA, 1683 bp, Influenza A virus
  misc_feature (1)..(1683): Codon Optimized Sequence Encoding H10 Hemagglutinin
atgtataagatagtcgtgataatcgcccttttgggagcggtgaagggactggacaagatttgtctcggccatcatgcagtcgccaacggtacaattgttaaaaccctcaccaacgaacaagaaaaagtgacaaatgccacagaaactgtggagagcaccggccttaaccggttgtgcatgaaggggcgaaagcataaggacttgggtaattgtcatccaattgggatgctgattgggactcccgcctgcgatctgcacctgaccggcacatgggataccattatcgagagggagaacgcgatcgcttactgctatcctggggctacagtcaatgaggaggccctaaggcagaaaataatggagtcagggggaatcgataaaatttctacaggcttcacttacggatcttctattaacagcgcaggcaccacgcgcgcctgcatgagaaatggcgggaatagtttttatgccgagctgaaatggctggtgtccaagagcaagggacagaactttccgcaaaccactaatacataccgtaatactgacacagcagaacatctgattatgtggggaatccaccacccctccagcactcaagagaaaaatgatctttacggaacacagtccctcagcataagcgtgggttcgagtacatataggaacaatttcgtgccagtggtaggcgcgcgaccgcaggtcaatggacagtcaggaaggatcgacttccattggactctagtgcaacctggggataatattacctttagccataatggaggtctgatagccccatctcgcgtctccaagctgattgggcgcggtctggggattcagagtgacgctcctattgataacaactgcgagagtaaatgtttctggcgcggcggctcgattaacacccgtcttccctttcagaacctgagtccccggacagtaggacagtgccctaaatacgtgaacaaaagaagtcttatgctcgccactgggatgcgaaacgttccggaactgatccagggtcgcggcctgttcggcgcaattgctggtttcctcgaaaatggatgggaaggtatggtggatgggtggtacgggttcagacatcaaaacgctcagggcacgggccaggctgccgactacaagagcacacaggctgccatcgaccagattactgggaaactcaatagactcgtggaaaaaactaatacggaattcgaaagcatcgaatctgagttcagtgagatcgaacatcagatcggaaacgtgatcaactggacaaaggattcgattactgatatttggacgtaccaggcagagttgttggtcgccatggagaatcaacacacaatcgatatggccgactcagagatgttgaatctttacgagagggtgcgaaagcagctgaggcagaatgccgaggaagatggaaaggggtgttttgagatctaccacgcctgcgacgattcttgcatggaatccatccgcaataatacatacgatcactcacagtatagggaggaggccctactcaacagactgaacatcaatcccgtgacactttcaagtggttacaaggatatcatactttggttcagcttcggcgccagttgctttgttctgcttgccgttgtgatgggcctggtgttcttttgcctgaagaatggtaacatgagatgtaccatctgcatt

SEQ ID NO: 819 - DNA, 1683 bp, Influenza A virus
  misc_feature (1)..(1683): Codon Optimized Sequence Encoding H10 Hemagglutinin
atgtataaaattgtcgttatcattgccttgctcggcgctgtgaaggggctggataaaatttgtctgggacatcacgccgtggcgaacgggactatcgtcaagacgcttactaacgaacaggaagaggtgactaacgcgacggaaaccgtggagtcaactgggattaatcgcttgtgcatgaagggcagaaagcacaaggacttaggcaactgtcatcctatcggcatgctgatcggtaccccagcctgcgaccttcacttgactggcacctgggataccctgatcgaaagagagaacgcaatagcatactgttatccaggcgccacagccaacgtagaggccctgagacagaagatcatggaatctggaggtatcgataaaattagcaccggatttacatatggatcaagtataaactcggcaggaacgacgcgggcgtgcatgcgaaatggcggaaattccttctacgccgaattgaaatggctagtgtccaaaagcaaaggccaaaactttccacagactactaacacctacagaaatactgacaccgctgaacatttgattatgtgggggatccaccacccaagtagcattcaggagaagaacgatctgtatggcactcagtcactaagtatttccgtgggcagctctacctaccgcaataacttcgtgccggttgtgggcgccagacctcaggtgaacggacaaagtggtcgcattgatttccactggacacttgtgcaacctggggacaatatcactttcagccacaacggggggctgatcgccccatcaagagtgagcaaattgatagggagaggcttgggaatccagtcagatgcacctatcgataataattgtgaaagcaaatgcttttggcgtgggggatccataaacactcgactgccattccagaatttgtccccccgcaccgttggccagtgtcccaagtacgttaatcgcagaagtctgatgctggccaccggcatgagaaacgtgcccgaactgatacagggacgcgggctctttggagcaattgccggctttctggagaacggatgggagggaatggtggacggatggtacggctttcggcaccagaatgcccaggggacaggacaagccgccgattataagtcaacacaggccgcaatcgaccagattaccggcaagctcaacaggctcgtggaaaagacaaacactgagtttgagtcaatcgagtcagaattttccgagatcgagcatcaaatcggcaacgtgatcaattggactatggattctatcaccgacatttggacttaccaggcagagctcctggtggcaatggagaaccaacacactatcgacatggcagattcagagatgctcaacctctatgaaagggtacgaaaacagcttcggcagaacgccgaggaggacggtaaggggtgttttgaaatctatcatgcgtgcgacgatagctgtatggaaagtatccggaataatacatacgatcactcccagtaccgcgaagaggctctcttgaaccggcttaacatcaacccggtaactctcagtagcgggtacaaggacatcattctgtggttttcttttggtgcctcctgttttgtgctgctggccgtggtgatgggactcgtgtttttttgcctcaagaacgggaatatgcggtgcacaatatgcatt

SEQ ID NO: 820 - DNA, 1683 bp, Influenza A virus
  misc_feature (1)..(1683): Codon Optimized Sequence Encoding H10 Hemagglutinin
atgtataagattgtggtgattattgctctcttgggggcagtcaaaggacttgataagatttgtctgggccaccatgctgtcgcaaatgggacaatcgtcaagacccttaccaacgagcaagaaaaggtaaccaacgcaaccgagactgttgagagtacagggctgaatagactctgtatgaagggccgcaaacataaggacctaggtaactgtcatccaatagggatgctgattggaacaccggcatgtgacttacacctcacaggtacatgggatactattatagagagagaaaatgccattgcctactgttatcctggggctaccgttaacgaggaagccttacgtcagaaaattatggaatccgggggcattgataaaatatccactggatttacttatggaagctcaatcaactccgcgggcactactcgagcatgtatgcgcaacggaggtaactccttctacgccgaactgaagtggctcgtttcaaaatccaaaggacagaactttccgcagaccactaatacctaccgcaatacagacacagcagaacatctgatcatgtggggcattcatcaccccagctctactcaagaaaagaatgacctgtacgggactcaaagtctgtccatttctgttgggtctagtacctaccggaataactttgtccccgttgttggagcacgccctcaggttaacggtcagagtggaaggatcgactttcactggaccctcgtccagcctggcgacaatatcacatttagtcacaacgggggcctaatcgctccctctcgggtgagcaagctgataggtcggggcttgggtatacagtctgacgccccaatcgataacaactgtgaaagcaagtgcttctggcggggtggctctatcaacacccgactgccatttcaaaatctcagtccaaggacagtggggcaatgcccaaaatacgtcaacaaaaggtcactcatgctcgccacaggaatgcgcaatgtgcctgaactgattcaaggacgaggactgtttggcgctattgccgggtttttagagaatggctgggaaggcatggtagacgggtggtacgggttccggcatcagaatgcccaagggacgggtcaggccgctgactataagtccactcaggccgcaatagatcagatcaccggaaagttgaacagactagtggagaagacaaacactgagttcgagtccattgagagcgaattcagcgagatagaacaccaaatcggcaatgtgattaactggaccaaagacagtattactgatatctggacttatcaagccgaactgttggtggcaatggagaaccaacacacgatcgacatggcagacagtgagatgctcaatctgtacgagagggtgcgtaaacagctgaggcagaacgccgaagaagacggaaaggggtgtttcgagatataccacgcctgtgatgactcctgtatggaaagcatcaggaacaacacttatgaccatagtcaatatagggaagaagcactgctcaaccgcctgaacatcaatcctgtaacactttcatcaggatataaggacatcatcctctggtttagtttcggagcttcatgctttgtgctgctcgcggtagtcatggggctggtcttcttttgtttgaagaacggtaacatgagatgcaccatttgtatc

SEQ ID NO: 821 - DNA, 1683 bp, Influenza A virus
  misc_feature (1)..(1683): Codon Optimized Sequence Encoding H10 Hemagglutinin
atgtacaaaatcgtcgtcatcatcgccttactgggagccgtcaaaggacttgataaaatttgtcttggtcaccacgctgttgccaatggaacaatcgtgaagacacttaccaatgagcaggaggaggtgactaatgcaacagagacagtggagtccactggaataaatcggctgtgcatgaagggcagaaaacacaaggatttgggcaactgccaccctattggaatgctcataggcacccctgcgtgtgaccttcatctgactggcacttgggacactctcatcgaacgcgagaacgccatcgcctactgctatcctggagccaccgccaacgtggaggctctacggcagaagattatggagagcggagggattgacaagatctccacgggtttcacttacggcagctccatcaacagtgccggtacaactcgggcgtgcatgagaaacgggggcaacagcttttatgccgagctgaagtggctggtgagtaagtcaaaagggcagaactttccacagacaacaaatacgtacagaaatacagatacagccgagcacctgatcatgtgggggattcatcatccaagttctatccaggagaaaaacgacttgtatgggactcagagtctcagtatcagcgtaggttcctctacctacaggaacaacttcgtgcccgtcgtcggggcccgtccccaagtcaacggccagagtggacggattgattttcactggactcttgtgcagcccggcgacaacattaccttcagtcacaacggagggctgattgcaccttccagagtctcgaagctgatcggacgtggattggggattcagtcggacgctcctatcgacaataattgcgagagcaaatgtttctggcgcgggggttctattaacaccaggctcccctttcaaaatttgagcccgcgaaccgtcggccaatgtcccaagtatgtcaaccggagaagcctgatgttggctacaggaatgcgcaatgtgccggagctcatccagggccgtggcttgttcggtgcaattgccggattcctagaaaatggatgggagggaatggttgatgggtggtacggcttccgccaccaaaacgctcagggcactggacaggccgcggactataagtctactcaggcggctatcgatcagatcactgggaaactgaataggcttgtggaaaaaaccaatacggagttcgaaagtatcgagtcagagtttagcgaaatcgagcatcagattggtaacgtgatcaactggaccatggatagcattaccgacatctggacctaccaggccgaattgctggtggccatggagaatcagcacacaattgacatggcagactctgaaatgcttaacctatatgagcgcgtacggaaacagctcagacagaacgcggaggaagatggaaagggctgcttcgaaatttatcacgcttgcgacgactcctgtatggagtctatcagaaacaatacgtatgatcattcgcaataccgggaggaagcactcctgaatagactcaacatcaaccccgttacactgagctcagggtacaaagacattattctctggttttccttcggagcttcttgcttcgtactgttagctgtcgtcatggggctagtttttttttgtcttaaaaacggcaacatgagatgcaccatctgtata

SEQ ID NO: 822 - DNA, 1683 bp, Influenza A virus
  misc_feature (1)..(1683): Codon Optimized Sequence Encoding H10 Hemagglutinin
atgtataaaatcgtggtaatcattgcactgctgggagcagtcaaagggctcgataaaatatgccttggccaccacgccgtagcaaatggtacaatcgtgaagaccctcacgaacgaacaggaggaagtcaccaacgctacagaaactgtcgaaagtaccgggatcaaccggctctgtatgaagggcaggaagcataaagacttaggtaactgccatcctatcggcatgctgattggcacacctgcctgcgacttgcacttaacgggaatgtgggacacattgattgagagagagaatgctattgcttactgttacccaggagcgactgtgaacgtggaggcactacggcaaaaaataatggagtccgggggaatcaataagatctcgacaggatttacctatgggagctcaatcaattctgcgggaacaacccgggcctgcatgcgcaatggcgggaatagcttctatgccgaactcaagtggctcgttagcaagagcaaagggcagaatttcccgcaaactactaacacatacaggaacacagacacagcagagcatttgattatgtgggggattcaccacccctctagtacgcaggaaaagaacgatctttacgggacccagtccctttctatcagcgtaggaagcagcacttacaggaataattttgtccctgtggttggcgcgggccctcaggttaatgggcaatctggccgcattgattttcattggaccctcgtacagcctggcgacaatataacattctcacataatggcggcctgatcgcaccttcccgggtatctaaattgataggtagaggcctggggattcaaagcgatgctccaatagataataactgtgaatcaaagtgcttttggcggggagggtcaattaatacgcggctaccctttcagaatcttagcccacgcaccgttggccaatgtccaaagtacgtgaatcgtagatcactgatgctggctacagggatgcggaatgtgccagaactcattcagggccgtgggctattcggcgctatcgccgggtttctggaaaacggctgggaggggatggtcgatggctggtacggcttccggcaccagaacgctcagggtacagggcaggcggctgattataaaagcacacaggctgcaatcgaccaaattactggaaaactaaataggctagtggaaaaaaccaacaccgaattcgaaagtattgaaagtgagttcagtgaaattgagcaccagattggaaacgtgatcaactggactaaggacagtatcaccgatatttggacatatcaggcagaacttctcgtggccatggaaaaccagcatactattgacatggctgacagtgaaatgttaaatctctatgagcgcgtacgcaaacaattgcggcagaatgccgaggaagatgggaagggctgcttcgaaatctatcacgcttgcgacgattcctgcatggagtccatcaggaacaatacatacgatcacagccagtatcgcgaagaagccctgcttaatagactaaatattaatcccgtcaccctgtcctcaggctataaggacatcatcctttggttttcatttggcgcaagttgcttcgtcttgctcgcagtcgtcatggggctgttttttttctgtctcaaaaacggaaacatgaggtgtaccatttgcatt

SEQ ID NO: 823 - DNA, 1683 bp, Influenza A virus
  misc_feature (1)..(1683): Codon Optimized Sequence Encoding H10 Hemagglutinin
atgtacaaaattgtggttatcatcgctttgcttggcgctgtgaaggggctggataagatctgtctcgggcatcacgctgtcgccaatggcacaattgtcaagacattgacgaacgagcaggaggaagtgacaaatgccactgaaacagtggaatccactgggatcaaccgattgtgcatgaaaggtaggaagcataaggatctcggtaactgtcatccaatcggcatgttgattggaaccccggcctgtgatcttcacctcactggtatgtgggacacactgattgaaagagaaaacgctattgcctactgttacccaggtgcaacggttaatgtcgaggcactgagacagaaaattatggaaagcggaggcatcaacaagatatcaaccgggtttacctatggctcatcgattaatagcgcaggcaccactcgcgcgtgtatgcgaaatggaggaaattcattttatgccgagttaaaatggctggttagtaagagcaagggtcagaacttccctcagaccacaaatacgtatcgcaatacggacactgcagaacaccttatcatgtggggtattcaccaccctagcagtactcaagaaaaaaatgacctgtatggtacccagagtctgagtataagcgtgggttccagtacttaccggaacaacttcgttccagttgtgggggcccgcccacaggttaacgggcaatcggggcgcatcgattttcactggaccttggtgcaacctggagacaatattactttcagtcacaacggcggattgatagctccatcccgtgtcagtaaattgattgggcgcggactgggaatccagtctgacgcacccatagataacaactgtgagtctaagtgtttctggaggggcggttccattaatactcggctgccatttcagaatcttagcccgcgcactgtgggtcaatgtcccaagtacgtgaacaggcgttctctaatgcttgccaccgggatgagaaacgttcctgaactgatacaaggtaggggactgttcggtgcaatcgctggctttttggagaatggctgggagggaatggtggacggctggtatggattccgccatcagaacgcccagggaaccggacaggctgccgactataagtccacgcaggccgcgattgaccaaattaccggaaaactcaatcgcctagtcgagaaaacaaacaccgaattcgagagtatcgagtccgaattttctgagatcgagcaccaaatcggcaacgtaatcaattggacgaaggattccattactgacatctggacctaccaagccgaattgttggtcgcaatggagaaccagcacaccatagacatggctgacagcgaaatgctgaacctgtacgagcgggttcggaaacagctgcgccagaacgcagaggaggatggcaaaggctgcttcgaaatctatcacgcctgcgacgatagctgcatggaatcaataaggaataacacttatgatcacagccagtatcgggaagaggccctgctgaatcggctcaacatcaatcccgtgactctctcttccggctataaagacattatcttgtggttctctttcggcgcgtcatgcttcgtgctgctggcagtggtaatgggactcttctttttttgcctgaaaaacgggaacatgcgctgcacaatctgcatc

SEQ ID NO: 824 - DNA, 1683 bp, Influenza A virus
  misc_feature (1)..(1683): Codon Optimized Sequence Encoding H10 Hemagglutinin
atgtataagattgtggtgattattgccctgctcggcgccgtgaaggggttggacaagatttgtcttggtcaccacgccgtggctaacgggaccatagtcaagactctgaccaatgaacaggaagaggtaacaaacgcaaccgaaacagtcgagtctacaggaatcaatcggttatgtatgaaaggccgaaaacataaagacctcggcaattgtcaccccatagggatgctgatcgggactccagcttgcgacctgcatttaacaggcatgtgggacactctcatcgagagagagaacgcgatcgcatactgctacccaggagctaccgtgaatgtagaggcattgagacagaaaatcatggaaagtggcggaataaataagatttctacagggtttacgtacggcagctccattaacagtgccggaacaacccgagcatgtatgagaaatggaggtaatagcttttacgccgaactgaagtggcttgtgtccaaaagtaaggggcaaaattttcctcagacaacgaacacctaccggaacaccgacacagctgagcacctgattatgtgggggatacatcatcctagcagcacgcaggagaagaatgatctatacgggacccaatctctcagcatctcagtgggctcctcaacttaccgcaacaacttcgtgcctgtcgtcggcgcccgccctcaggtcaacggtcagtctggccgaatcgactttcactggacactggtgcagcctggagacaacatcactttctcccataacgggggacttatcgcaccgagcagagtgagcaagctgattggaagaggactcggaatacaatccgatgccccgatagataataattgtgagagcaagtgtttctggcgcggcggatccatcaatacacgcttaccgtttcagaacttgagcccacggactgttgggcagtgcccaaagtacgtgaaccgccgcagtttaatgcttgctaccggtatgagaaatgtacctgaactcattcaaggcaggggcctgtttggcgcaatcgctggctttctcgaaaatggatgggaaggcatggtagacggttggtacggattcagacaccagaatgcccagggcacgggtcaagcagccgattataaaagcacacaagcagcaattgatcagattacaggtaagctcaaccgtctcgtggaaaaaactaacaccgagttcgaatccattgagagtgagttcagtgagatagagcaccagatcggaaatgtgattaactggacaaaagatagcattacagatatctggacgtaccaggctgagctcttggtggcgatggaaaatcagcataccattgacatggccgactcagagatgcttaacctgtatgagagagtgcgcaaacagcttagacagaacgccgaagaggatggcaagggatgtttcgagatctaccacgcttgtgatgacagctgtatggagagtattagaaacaacacgtatgaccattcccagtaccgagaggaggctttgcttaatcgtttgaatattaaccccgtcacgctcagcagcgggtacaaagatatcatactctggttctctttcggagcatcatgcttcgtacttttggctgtggtgatggggctgtttttcttctgcttgaaaaacggcaacatgaggtgcactatctgtatc

SEQ ID NO: 825 - DNA, 1683 bp, Influenza A virus
  misc_feature (1)..(1683): Codon Optimized Sequence Encoding H10 Hemagglutinin
atgtacaaaatcgttgtgatcattgctctgttgggcgcggtaaagggcctagataagatttgtctgggccatcacgccgttgccaacggcactatagttaaaacgctgacaaatgaacaggaaaaggtaactaacgccaccgagactgtggagtccactggtctgaaccgactctgcatgaaagggcgaaaacataaagacctgggcaactgtcacccaattgggatgctgatcgggacacctgcctgcgatctccacctgaccggtacatgggacacaatcattgaaagggaaaacgccatcgcctactgttatccaggcgctacagtcaacgaggaagcattgcggcagaaaattatggagtctggcggaatcgataagatatccactggcttcacctacggatcgtctattaactctgcgggtacgacacgcgcctgtatgaggaacggcggaaatagcttttacgctgaactaaagtggttagtttctaagagcaagggccagaatttcccacagaccacaaatacatacaggaatacagataccgctgagcatctaatcatgtggggaatacaccacccctcgtcaactcaggagaagaatgatctgtatggcacacagtctctgtcaatttccgtgggctcaagcacatataggaacaacttcgtgcctgttgttggcgccagaccccaagtcaatggccagtctggaaggattgacttccattggaccctggtccaacccggggataatatcaccttttcccataatggagggctgatcgcgcctagtcgcgtcagtaaactcatcgggagagggctgggaattcaatcagatgcccccattgataacaactgtgaaagtaaatgcttttggcgggggggttccatcaatacacgcctgccatttcagaatctgagccccaggacggttggtcagtgccccaagtacgtgaacaagagaagcctgatgctggcaactgggatgcgcaatgttcctgaactgattcagggacgcgggttatttggagctattgccggttttctcgagaatggctgggagggaatggtcgatgggtggtacggatttagacaccaaaacgctcagggaacaggccaggcggctgattacaaaagcacccaggccgctattgatcagatcactggaaaactgaaccgccttgtcgagaaaacaaacaccgaatttgagagcatagagtccgaattctcagagattgaacatcaaattggcaacgtgataaattggactaaagactccattaccgacatctggacctaccaggccgagctcttggttgctatggaaaatcagcatactatcgacatggccgactctgaaatgcttaatctgtacgaacgcgtgagaaaacagttacgccagaacgcggaggaagatggcaaagggtgcttcgagatctaccatgcatgcgatgacagctgtatggaaagcatccgtaataatacctatgatcactctcagtatagggaagaggccctgttgaatagattaaacattaacccagtgacactgagcagcggctataaggacattattttatggttttcctttggagcaagttgttttgtgctgctggcggtggtgatggggctcgtgttcttttgcctgaagaatggtaacatgcgctgtactatctgtatt

SEQ ID NO: 826 - DNA, 1683 bp, Influenza A virus
  misc_feature (1)..(1683): Codon Optimized Sequence Encoding H10 Hemagglutinin
atgtacaagatagtcgtgataattgcactcctcggcgcagttaagggcttggataagatctgcctgggacaccacgccgtcgcgaacggcactattgtcaagactttaacgaacgagcaagaagaggtaacaaatgcaacagaaactgttgagagcacgggcatcaatcggctgtgcatgaagggtaggaagcataaggacctgggaaactgtcaccccatcggcatgctgatcgggacccccgcatgtgatttacaccttacaggaatgtgggatactctgatcgaaagagagaatgccattgcttactgttaccctggggccacggtgaacgtggaggcccttaggcagaaaatcatggaaagtggagggatcaacaagatttccaccggtttcacgtatggctcttctattaattccgctggaaccactagggcctgtatgcgaaatggaggcaactccttctacgctgaattgaagtggctggtaagcaagtccaaagggcagaatttcccacagacaacaaacacgtacagaaacacggacaccgctgagcacctcatcatgtggggcatccaccaccctagctctacccaggaaaaaaatgatttatacggaacgcagtctctttcaatctccgtcggctcaagcacttatagaaataattttgtgcccgtcgtgggggcccggccccaggtaaacggccaatcagggaggatcgactttcattggaccctggttcagcccggggataacataacctttagccataacggaggtcttatagcgccgagtcgagtgtcaaagctgatcgggcgcggtttgggcatccagtctgatgcccccatcgacaacaactgcgagagcaaatgcttttggaggggagggtccattaatacccgtctgccattccagaatctctctccccggaccgtcggccagtgccccaaatacgtgaatcgtcgttctctcatgctcgccaccggaatgcgcaacgtgcctgagttgatccaaggtcggggactgttcggggccattgccggctttctggagaacgggtgggaggggatggtggatggctggtacggctttaggcaccagaacgctcagggaactgggcaggcggccgactacaagtcaacccaggccgcaatagatcaaattacaggcaagctgaaccgactggtcgaaaaaaccaacacagaattcgagtccatagaatccgaattttctgaaatagaacaccagattgggaacgttatcaattggactaaagattccatcaccgatatctggacatatcaggccgaactgcttgtggccatggaaaaccagcataccatcgatatggctgactccgaaatgttgaatttgtatgaaagggtacgcaagcagctgaggcagaacgctgaggaggacggtaagggatgttttgagatctaccatgcatgcgatgacagctgtatggagtcaatacgcaacaacacttatgaccactcccaatatcgggaggaagcacttctcaatcgcttgaatattaatcccgtcactctgtctagtggttataaggacattattttgtggttcagctttggagcctcctgtttcgttctactggccgttgtgatgggactattctttttctgcctcaaaaacggcaacatgcggtgcaccatctgtatt

SEQ ID NO: 827 - DNA, 1683 bp, Influenza A virus
  misc_feature (1)..(1683): Codon Optimized Sequence Encoding H10 Hemagglutinin
atgtacaaaataattgttatcatagccctcctgggtgccgtcaaagggctggataaaatatgcttagggcaccacgcggttgctaacggcaccatcgtcaaaaccctcacaaacgaacaggaggaagtcaccaacgcaacagaaacagtcgaatcaacgggcatcaatagactgtgtatgaaagggcgcaagcacaaggacttgggaaactgccacccgattggtatgctaattggaaccccagcctgtgacctacacctgaccgggacttgggatactcttattgagcgcgaaaacgctattgcgtattgttaccctggggctaccgtcaacgttgaggcactgagacagaaaataatggaatcaggtggcatagacaaaatttctaccggcttcacctacgggagcagcataaactccgctggcactacacgcgcctgtatgaggaatggcggcaactccttctacgccgagctgaagtggctggttagtaagtccaagggacagaacttcccacagaccaccaacacttaccgcaacaccgatacagccgagcacctgattatgtggggaatacaccacccaagctctacccaggaaaaaaacgacttgtacggcactcaaagtctgtccatctccgttgggtcgtccacttaccgcaataatttcgtccccgtggttggagcccgccctcaggtgaacggccaaagcgggcgcatcgatttccattggaccctcgttcagcctggcgacaacattacctttagtcacaatggcggtctgattgccccttcacgcgtgtccaagttgattggacggggattgggcatccagtcggacgcacccatcgataacaattgtgagagtaaatgtttctggcggggtggctccattaatacccgactgccattccaaaacctctctcctcgtacggtgggtcagtgtcccaagtatgtgaacagaagatctctgatgttagcaaccggtatgagaaacgtcccggagctgatccagggcagaggcctgttcggagccattgcggggtttcttgaaaacggatgggagggcatggtggacggatggtatgggtttcgacatcaaaatgcccaggggaccgggcaggcagctgactacaaatctacccaggcggcaatagatcagatcactggaaagttaaacagactcgtggagaaaactaacactgagttcgaatctatcgagtcagagttttcagaaattgaacatcagatcggaaacgttatcaattggacgaaagatagtatcacagacatttggacctatcaagctgaattgcttgtggccatggaaaaccaacataccatcgacatggctgactcggaaatgttgaatttgtacgagcgggtgaggaagcaactgaggcaaaatgccgaggaggacggcaaaggctgctttgagatctaccacgcatgcgatgactcttgtatggaaagtattcggaataatacttatgaccattcccagtatcgtgaggaagcactgctcaaccgcctaaatattaatcccgtgaccctgtcatcagggtataaggacattatcctttggttttccttcggcgctagctgtttcgtgctgctagcggtagtgatgggccttttcttcttttgtttgaagaatggcaatatgcgatgcacaatctgcata

SEQ ID NO: 828 - DNA, 1683 bp, Influenza A virus
  misc_feature (1)..(1683): Codon Optimized Sequence Encoding H10 Hemagglutinin
atgtataagatcgtggtcatcatagccctgctcggagccgttaagggtcttgacaagatttgtcttggtcatcatgctgttgctaacggaaccatcgtgaaaactctgacaaacgagcaggaggaagtgacaaacgccacggagacagtggaatctactggaatcaaccgcttatgcatgaaaggcaggaaacacaaagacctggggaattgccacccaattggaatgctgatcggcacacctgcctgcgacctgcatctcacagggatgtgggatacactgatcgaaagagagaatgctatcgcatactgctacccaggggctactgtcaatgtggaggcccttcgacagaagattatggaatccggaggtatcaacaaaattagcactggcttcacctacgggtcttccatcaattctgccggcacgaccagagcatgtatgagaaatgggggcaacagtttttacgccgagttgaagtggctggtgagtaagagcaaaggacagaacttcccgcagaccaccaacacatacaggaatacggataccgccgagcacttaatcatgtggggaattcaccaccccagttcgacacaggagaagaacgatctctatggcactcagtctctgtctatttctgtgggatcatcaacatatcgcaataactttgtacctgttgtgggggctaggcctcaggtgaacggccaatccggacgaatcgacttccactggactctggttcaaccaggtgataatattactttctcacacaacggcggactgattgcacctagccgagtgagtaagctcattggtagaggactggggattcagtccgatgcccctatagacaataactgcgaaagcaaatgcttctggcgcggcggaagcataaatacaagattgccatttcagaacctgagtcctcggaccgttggacagtgtcctaaatacgtgaacagaagaagcctgatgcttgccactggcatgcggaatgtgcccgagctcattcagggacggggcctattcggcgcaatcgccggatttctggagaatggttgggaagggatggtcgatggctggtacggctttagacaccagaatgcacaggggacagggcaggcggccgattacaaatccactcaggctgctatcgaccagatcaccggcaagttaaataggttggtcgagaagacgaacaccgaattcgaatctatcgagtcagagtttagcgagattgagcatcagataggtaatgtgattaactggactaaggacagcatcactgatatctggacttaccaggcagagctcctggttgccatggagaaccagcacacaatagacatggccgacagtgaaatgctaaacctgtacgaacgcgtgcgcaagcagctccggcagaacgcagaagaagatggcaaggggtgttttgagatatatcatgcatgcgatgactcctgtatggagagtatccgtaacaacacttacgatcactcccagtaccgtgaggaggctctgctgaacagactgaacatcaaccccgtaactttaagtagtggatataaggatatcattctttggtttagcttcggagcaagctgtttcgtccttctcgcagtggttatgggcctgttctttttttgcctaaagaatgggaatatgcggtgcacaatatgtatt

SEQ ID NO: 829 - DNA, 1683 bp, Influenza A virus
  misc_feature (1)..(1683): Codon Optimized Sequence Encoding H10 Hemagglutinin
atgtataagatcgtggtgattattgccctgctgggcgctgtgaagggcttagacaagatttgcttaggtcaccatgcagtggcaaatggaacaattgtcaagacattgaccaatgaacaggaggaggtaaccaacgctacagaaaccgttgagtccaccggtattaaccggctttgcatgaagggtcgcaagcacaaggatctgggcaattgccaccccatcggtatgctcattggaactcccgcatgtgatctgcatctgacagggatgtgggatacgttgatagagcgtgagaacgccatcgcctactgttacccaggtgccacagtgaacgtggaagccctgcgtcaaaagatcatggaatccggagggatcaataaaattagtacaggcttcacgtatggctcttccatcaactctgctgggactactcgtgcgtgcatgcggaatggaggcaattcattttacgcggaactaaaatggcttgtgagcaaaagcaaaggacaaaacttcccgcagacgaccaacacgtatcggaacaccgacaccgccgaacatctaatcatgtggggcatccatcatccctcatccacccaggaaaaaaatgacttatacggaacacagtcattgagcatttccgtaggatcaagtacataccgaaataatttcgtgcctgtggtgggtgcgggcccccaagttaatggccaatcaggccgtattgactttcattggaccctcgttcagcctggcgacaacatcaccttctcccataacgggggactcatcgccccatcaagagtgtcgaagctgatcggccgaggactcgggatacagtctgacgcccccatcgacaataattgtgaatccaagtgcttttggagaggagggtcaatcaacacccgcctaccttttcagaatctttcacccaggaccgttgggcagtgtcccaaatacgtgaaccggagatctctcatgcttgcaaccgggatgagaaacgtgccagagctcatccaggggcgcggcctatttggggccatagccggttttctggagaacggatgggagggaatggttgatggctggtacggcttcaggcaccagaacgcacagggcaccgggcaagccgcagactacaaatcaactcaggcggctatcgatcagatcacaggtaaattaaaccgactcgtcgaaaagacaaataccgagtttgagtctatcgaatccgagttttctgaaattgagcatcaaatcggcaacgtgattaactggactaaggactccatcaccgatatttggacttatcaagcagaactactggtcgccatggaaaatcaacatactatcgatatggcagatagcgaaatgcttaacctctacgaaagagtgcgaaagcagctacgccaaaatgccgaggaagacgggaagggctgcttcgagatttaccatgcgtgtgatgattcctgcatggaaagtattaggaacaatacttatgatcacagccagtatcgtgaggaagctctgcttaacagacttaacatcaatccagtgacactcagcagtgggtacaaagacatcatcctctggttcagctttggagcttcttgcttcgttttgcttgctgtagtcatgggactgttttttttttgtctgaagaacggtaatatgcgatgcactatttgtata

SEQ ID NO: 830 - DNA, 1683 bp, Influenza A virus
  misc_feature (1)..(1683): Codon Optimized Sequence Encoding H10 Hemagglutinin
atgtataagatcgtggtcatcatcgctttgctgggggctgttaaggggctcgacaagatttgtttgggccaccacgccgtggccaacgggaccattgtgaagacgctgacaaatgaacaagaagaagtcacaaatgccacagagactgttgaatccactggcattaatagactctgcatgaaaggcaggaaacacaaagatctgggcaactgtcaccctatcggaatgctgattggcactcccgcttgtgatctccatcttacaggtatgtgggatacccttattgagcgagaaaatgccatcgcctactgttatccaggtgctactgtgaacgtggaggccttgaggcagaagattatggagtcaggaggcatcaataagatttccaccgggtttacatacggctcatccatcaactccgccggcacgactcgagcttgcatgagaaacggtggcaactccttttatgcggagctaaagtggctggtcagcaagtcaaaaggtcagaacttcccccagactacgaacacctatcggaatacagacaccgctgagcatttgatcatgtggggaatccaccatcctagctccacccaggagaagaatgacctgtatggaacacaatctctttctatctccgtgggctcttctacctaccgtaacaatttcgttcccgttgtgggggctcggcctcaggtgaatggtcaatccggaagaatcgactttcactggacattagtacagcccggcgacaacattacatttagtcataatggggggctgatcgcgcctagtcgggtctcaaagttgatcgggagaggcctcggaatccagagcgatgcacctatcgataacaactgtgaaagcaagtgcttctggcgcggcggttctattaataccagattgcccttccagaacctgtctccccgaacagtcgggcagtgccccaaatacgtgaacaggagatctctgatgctggccacagggatgcgcaacgtgccagagctgatccagggaaggggtctcttcggggccattgccggctttctggaaaatggctgggaagggatggtggacgggtggtatggcttcaggcaccaaaacgcgcaaggcactggccaggcggcggattacaagagcacgcaagctgctatagaccagatcacggggaagctgaacagactcgtggaaaagactaatactgaatttgaatcgatcgagtctgagttctccgaaatcgagcatcagatcgggaatgtcataaattggaccaaggattccattacagatatttggacctatcaggccgaactgctggtggccatggagaatcagcacactattgatatggccgacagtgagatgctgaacctgtatgagcgtgttaggaagcaacttcgacagaacgcagaagaagatggtaagggatgtttcgagatttaccatgcctgtgacgacagttgtatggagagcattaggaataacacttatgaccatagccaataccgggaagaagctttgttaaatcgcctgaatatcaatcccgtcacgttatcgtcggggtataaggatattattctgtggttcagcttcggagcgtcctgctttgttctgttggccgtggtaatggggctgtttttcttttgtcttaagaacgggaacatgcgctgcacaatctgcatc

SEQ ID NO: 831 - DNA, 1683 bp, Influenza A virus
  misc_feature (1)..(1683): Codon Optimized Sequence Encoding H10 Hemagglutinin
atgtacaagattgtggttatcatcgcactgttaggagccgtgaaggggttggacaagatctgtctggggcatcatgccgttgctaatggaacaatcgtgaagacgctcaccaatgaacaagaagaagtcacaaacgccaccgaaaccgtggagagcaccggaattaacagactttgtatgaagggacgcaaacacaaggatctggggaactgccacccaatcggcatgctgataggaacccctgcctgtgatctgcacttaactggcatgtgggacacacttatagagcgcgagaacgcgatcgcgtactgctaccccggagcaaccgttaacgtcgaagctttgaggcagaaaattatggaaagcggcggcataaataaaatttctactggctttacgtacggcagctctataaacagtgctggcaccactcgtgcctgtatgcggaacggcggcaattccttttacgccgaattaaaatggcttgttagcaagtcaaagggccagaactttccgcagacgactaatacataccgaaacaccgacaccgctgaacatctgattatgtggggtatacatcatccaagttccacccaagaaaaaaatgacttgtatgggacccagagcctaagcatctccgtggggagttctacttaccgaaacaacttcgtacctgtggtgggggcccgaccacaggtaaatggacagtcgggccggattgatttccactggaccttggtgcagccgggagataacataacattctctcataacggaggtctcatagccccaagtcgtgtgtcaaagctcatcggtagaggcctgggcattcagtcagacgcacccattgataataactgtgagtctaaatgcttttggcgcggcgggagtatcaatactagactgccttttcagaacctcagcccaaggaccgtggggcagtgtcccaagtatgtaaatcggcgaagcttaatgctggctactggtatgcggaatgtgcctgaactcattcagggacggggcctcttcggagcaatagctggtttcctggagaacggctgggaaggcatggtggatggttggtacggttttagacaccaaaatgcccagggaacgggacaggctgccgactataagtcaactcaagccgcgatcgaccagatcactggtaaattaaaccgactcgtcgaaaagacaaacacggagttcgagtctatcgaaagtgagttctcagagattgaacaccaaatcgggaatgtgattaactggacaaaggactcgataaccgatatctggacctaccaggcagaacttctggtggccatggaaaaccagcacactattgacatggccgactcagagatgctgaatctgtacgagagagtgaggaagcagctccgccagaatgcggaggaggatggtaaaggctgcttcgaaatctaccacgcttgcgatgactcctgcatggaatcaatccgaaataatacatatgaccactcacagtacagagaagaagcccttctgaaccgcctgaacatcaaccccgtgacgctgagttcaggatataaggatatcattctctggttctcctttggggcgagttgcttcgtgctgcttgcggtagtcatgggactcttttttttttgtcttaagaacggtaatatgcggtgcactatttgtatc

SEQ ID NO: 832 - DNA, 1683 bp, Influenza A virus
  misc_feature (1)..(1683): Codon Optimized Sequence Encoding H10 Hemagglutinin
atgtacaagatcgtggtaattatcgccctgctcggagctgtgaaaggattagacaaaatttgcctcggccaccatgctgtagctaatggtacaatagtcaaaaccctaactaatgaacaggaagaggtgactaatgcaacggaaactgtcgagagtaccggcattaaccgcctgtgtatgaaagggagaaagcacaaggacttaggcaattgtcatccaatcgggatgctaattggcactccagcctgtgatctgcatctgaccggaatgtgggacaccttaattgagagggaaaacgccatagcctattgctatcctggggcaactgttaatgtggaagctctccggcaaaaaatcatggaatctggaggcattaataagatctccacgggcttcacatatgggtcctctatcaattccgccgggaccacgcgcgcatgcatgagaaacggagggaattctttctacgcggaacttaagtggctggtcagtaagtctaaagggcagaattttcctcagaccactaatacctacagaaatacggatacagctgagcacctcattatgtggggaatacaccacccttcaagcacacaggaaaaaaacgatctctacgggacccagagcctgtccattagtgtcggatctagcacataccggaacaatttcgtacccgttgtgggagcacgcccacaggtgaatgggcagtcaggcagaatcgatttccattggactctcgtgcagcccggcgataatataaccttcagtcataatggcggattgatcgccccctcgcgtgtttcaaaattaatcgggagggggctcgggatacaaagcgacgctcctatcgacaacaactgtgagtccaagtgtttttggcgcggcgggagcattaatacccgtctcccgttccagaacctgtctccccggacagtaggacagtgtccgaagtatgtcaatcgtagaagtcttatgctggcgacgggaatgcggaacgtgcccgagctgattcaaggccggggtctgttcggagcaatagctggtttcctggagaatggttgggagggcatggttgacggctggtatgggttcagacatcagaacgcacagggaaccggccaggctgctgactataaatccactcaggcagccatagatcagatcaccgggaagctaaaccggctggttgagaaaactaatacggagttcgagtctatcgagtccgagtttagcgaaatagagcatcagatagggaacgtgataaattggacgaaagactctattaccgacatctggacctaccaggcggaactgctggtggctatggagaatcagcacaccatcgacatggctgatagcgaaatgttgaatctgtacgagcgggtcagaaaacagttaagacagaacgcagaggaagatggaaagggctgcttcgaaatatatcacgcatgtgatgattcctgcatggagtctattagaaacaacacttatgaccattcgcagtaccgcgaagaagcgctgctaaacagactcaacatcaatcctgtgaccttgagtagcggatacaaggacattatactgtggttctcctttggtgcctcctgttttgtcttgcttgccgtagttatgggcctgttctttttctgcttgaagaacgggaacatgcgctgcacaatttgtatc

SEQ ID NO: 833 - DNA, 1683 bp, Influenza A virus
  misc_feature (1)..(1683): Codon Optimized Sequence Encoding H10 Hemagglutinin
atgtataaagtggtggtgattatcgctttactgggagctgtaaaggggctggataagatttgtctgggacatcacgcagtcgcgaacggcaccattgtgaaaacacttactaatgaacaggaggaggtgaccaacgccaccgaaaccgtcgagtcaacaggtataaacagattgtgcatgaagggccgaaagcacaaggacctgggaaattgtcatccaattggaatgttgatcggcactccagcctgcgatcttcatcttaccggaacatgggacacgcttattgaacgggaaaatgcgatcgcatattgctaccccggggccacagtgaatgtggaggcactgagacagaaaatcatggaaagtggcgggatcgacaagattagtactggctttacatacgggagcagcatcaactccgccgggaccacccgagcctgcatgaggaacgggggcaacagtttttatgctgagctgaagtggctcgtgtcaaaaaataagggccagaatttccctcaaacaacgaatacatatcgcaacacagatacagcggaacacttaatcatgtggggcattcaccaccctagctccattcaagaaaagaacgatctctacggaacacaatcgttgagcatctcagtggggtcttccacctatagaaacaactttgtacctgtggtcggcgcaagacctcaagtcaatggacaaagcggcagaatcgacttccactggactctggtgcagccaggcgataatataaccttctctcacaacggcggcttgatcgctcccagccgggtatctaagttaatcggccgtggtctcggaatccagagcgatgcaccgattgacaataactgtgaaagtaaatgtttctggcgtggcggctctataaacactagactccccttccagaacttgagtcctagaacagtggggcagtgcccgaaatacgtcaaccggagatcgttgatgctcgcaactggcatgaggaacgtccccgagttaatacagggacggggactattcggcgccatagccgggttcctcgagaacggatgggagggtatggttgatggttggtacggctttcgacatcaaaacgcacaaggtacagggcaggctgccgattacaagagcactcaggccgccatcgaccagatcactgggaaactcaacaggttagtggagaaaaccaataccgaatttgaatccatcgagagcgaattctcagagattgagcatcagataggaaatgtgataaactggaccatggatagtattacagacatttggacgtaccaagcagagctgcttgtcgcgatggagaatcaacacaccatcgacatggcggactccgaaatgctgaatctgtatgagagggttcggaaacagcttagacaaaatgcagaggaggatggcaagggctgctttgagatctaccacgcatgtgatgactcctgtatggaatccatccggaacaacacgtatgaccactctcagtacagagaagaggctctcctgaatcgccttaatattaaccctgtgacactgtcctccggctataaggatatcatcctgtggtttagctttggagcaagctgcttcgtgttgctggccgtagttatgggcctggtcttcttctgtcttaagaacggaaacatgcggtgcacaatctgtatt

SEQ ID NO: 834 - DNA, 1683 bp, Influenza A virus
  misc_feature (1)..(1683): Codon Optimized Sequence Encoding H10 Hemagglutinin
atgtataaggtcgtcgttattatagcgctgcttggagctgtcaaaggtttggataaaatctgtctgggccatcacgcagtcgccaacggtaccattgtgaaaacgctcacaaacgaacaggaagaggtcacgaacgccacagagactgtggagtctacagggattaaccgcctgtgcatgaaaggccggaaacataaggaccttggcaactgccatccaatcggcatgctgattggcactccggcctgtgatctgcatttgaccggcacatgggataccctgatcgaaagggagaatgccatcgcttactgttatcccggcgcaactgtgaatgtggaggcactgagacagaagatcatggagtctggggggatcgataaaattagtaccgggtttacttacggcagttcgattaatagcgcgggaacaacgagggcgtgtatgaggaatggaggaaactccttctatgccgagctcaagtggctggtgagcaagaacaaggggcaaaactttccccaaacaactaacacataccggaatacagatactgctgaacatctgataatgtggggaatccaccatccttcttcaattcaggagaaaaacgatctttacggaactcaaagtttaagcataagtgtggggtcatctacgtatagaaacaactttgtgcccgtggttggcgcaaggccgcaggtgaatggtcaatctgggaggatagatttccactggacattggtgcagccgggtgataatatcaccttttcccataatgggggattgattgccccctcccgggtgtcgaaacttattggccgcgggctaggtattcagagtgacgcccccattgataataattgtgagtctaaatgtttttggcggggtggcagcattaatacacgtctgccattccagaacctgtcccccaggactgtcgggcaatgccccaaatacgtgaatagacggtctctgatgctggccactgggatgcgcaatgtacccgagcttatccagggacggggcctttttggggccatcgccggtttcctggagaacgggtgggaaggcatggttgatggctggtatgggtttagacaccagaatgctcaagggactgggcaggcggccgattataagagtacacaggcggccatcgaccagatcacaggcaagctcaaccgtctggtggagaaaacaaatacagaattcgaaagcatagagagtgaattttctgagattgagcaccagattggtaatgtcatcaattggacaatggattccatcactgacatctggacataccaagccgagctattggtggcgatggagaatcagcatacaatagatatggccgactctgaaatgctgaacttatatgagagagtgcgtaaacagttgaggcagaatgctgaagaagacggtaagggatgttttgagatatatcatgcctgtgatgacagttgcatggaatccatcagaaataacacttacgaccacagccagtacagagaggaagccctactgaacaggctcaatatcaatccagtgactctatccagcggctacaaggacattatcttatggttttcttttggtgcttcatgttttgtgctcctcgccgtggtcatggggctcgtcttcttctgtttaaagaatgggaatatgcggtgcacaatatgtatc

SEQ ID NO: 835 - DNA, 1683 bp, Influenza A virus
  misc_feature (1)..(1683): Codon Optimized Sequence Encoding H10 Hemagglutinin
atgtacaaaatagtagtaatcattgctttgcttggcgcggtgaaaggcttggataagatttgcctgggacaccatgctgtcgcgaatggaaccatagttaagactttgactaatgagcaagaggaggtgaccaacgccaccgaaacggtggagtccacaggcatcaacaggctctgtatgaaaggacggaagcataaggacctggggaactgtcatccaattggaatgctgatcgggacgcccgcgtgtgacctccatctgacagggatgtgggatactcttattgagagagagaacgctatcgcctactgttatcctggtgctacagtgaacgtggaagccctcaggcagaagattatggagagcggtgggatcaacaagattagtacagggtttacctatgggtcatccataaacagtgcgggcactacccgagcgtgcatgcgcaatgggggcaattcgttctatgccgaactgaagtggttagtctctaagtctaaaggtcagaattttcctcagacaactaacacataccggaataccgataccgctgaacacctgatcatgtggggaatacatcaccctagtagtacacaagagaaaaatgacctatatgggacacagagcctgtcaattagcgtgggtagttccacatatagaaacaactttgttcctgtcgtgggtgcccggcctcaggtaaatgggcagagcggacggatagattttcattggactttggtccagcccggggataacattaccttctctcataacggggggctgatcgctccaagccgggtgtctaagctcataggcagaggcctgggtatccaatcggacgcccccatcgataacaactgtgaaagtaaatgcttttggaggggcggcagtattaatacgcggctaccgtttcagaatctgtctccacgcacagtagggcagtgtccaaagtacgtcaaccgcagatccctcatgctggccacggggatgaggaacgtgcccgagctgatccaggggaggggcctatttggggctatcgccggcttcctggagaatggttgggagggaatggtcgatggctggtacggctttcgccatcagaacgcccaaggaactggacaagctgccgactacaaaagcacgcaagccgccatcgatcaaattaccggaaagctgaatcggctagtggagaagaccaacaccgaatttgagtctatagagtcagagtttagcgaaatcgagcatcagattggcaacgtcattaattggaccaaggacagcataaccgacatatggacataccaagccgaactcctggtagctatggaaaatcagcataccatcgatatggcagattccgaaatgctgaacctgtatgaaagagtgaggaagcaactgcgtcagaatgccgaggaagacggcaaggggtgctttgagatctaccacgcatgtgatgattcttgcatggagagcatcaggaataatacatacgaccacagccagtaccgggaagaagccctattgaacaggcttaacatcaatcccgtcactctatccagcggctataaagatataatcttatggttttcctttggcgcgtcttgctttgtgctcctggcggtggtgatgggcttattcttcttttgtctcaagaatggcaacatgaggtgcacaatctgcatt

SEQ ID NO: 836 - DNA, 1683 bp, Influenza A virus
  misc_feature (1)..(1683): Codon Optimized Sequence Encoding H10 Hemagglutinin
atgtacaagatagtggtcatcatcgcactcctgggcgccgtgaagggcctggataaaatttgcctggggcaccatgccgtcgtgaacggcacgatcgtcaagactctcactaatgagcaggaggaagtcactaatgctacggagacagttgagtcgaccggattgaatagattgtgcatgaagggacgtaaccacaaggacctcgggaactgccacccaattggcatgttgatcggaacacccgcctgcgatctccatctgaccggtacgtgggatacacttatcgagagggaaaacgcaatcgcctattgctatcccggtgcaaccgttaacgaagaagctctgaggcagaaaatcatggagtctggtgggattaacaagattagtacagggtttacatacggaagctccatcaacagtgcaggcactacccgtgcctgcatgagaaacggaggcaactctttttacgctgaacttaaatggttagtaagcaagagtaaaggccagaattttccacagacgacaaacacatacagaaacaccgacacagccgaacacctgatcatgtggggcatccaccacccatccagcacccaggagaagaacgatctatatggaactcagagcctgtctattagcgtaggcagttcaacctaccagaataacttcgtgccagtggtgggagctcggcctcaggttaatggacagagcggcagaatcgacttccactggactctcgtgcaacccggcgataacatcactttttcgcataatggaggcttaatcgcaccctcccgagtcagcaagctcatcggaaggggattaggcatacagagtgatgcacccatcgataacaactgcgaaagtaagtgcttctggcgagggggttccattaatactagattaccatttcaaaatctgagtccaagaaccgttggtcagtgcccgaagtatgtcaataagcgttctctgatgttggcaactgggatgaggaatgtgccagaactgatgcaagggcgaggcctctttggtgcaatcgctggctttatagagaacgggtgggaagggatggtggatggctggtatgggttccgccatcagaatgcacaaggcaccggtcaggccgccgactacaagtcaacccaggcggctatcgatcaaatcacggggaaactgaacaggttaatcgaaaaaacaaacacagagttcgagtcaatcgagtctgagttttctgaaattgagcaccaaatcgggaatgtgattaactggacaaaagactctatcacagacatctggacctaccaggccgaactcctggtggccatggagaatcaacacaccattgacatggcggactccgaaatgctgaatctgtatgagagggttaggaaacaacttaggcagaatgctgaggaagacggcaaaggctgttttgaaatttaccacgcctgtgatgatagttgtatggagagcattcggaacaatacctacgatcactctcaatatcgcgaggaagctctgcttaacaggcttaacattaaccccgtgacgctgtcaagtggctacaaagacattattctctggttctccttcggtgcatcatgctttgttctgctggctgttgtcatgggcttagtgttcttctgcctcaagaacggtaatatgagatgtaccatctgcatt

SEQ ID NO: 837 - DNA, 1683 bp, Influenza A virus
  misc_feature (1)..(1683): Codon Optimized Sequence Encoding H10 Hemagglutinin
atgtataaggtggtggtgatcatcgccctcttgggtgctgttagagggctggataaaatctgtctaggacatcatgccgtggcaaacggtactatcgtaaaaactctgacaaatgagcaggaggaggtgaccaacgctactgagaccgtcgagtcaaagagcctgggaaagttgtgcatgaaagggaggtcatataatgacctggggaactgtcaccctataggtatacttattggcacccctgcctgcgatctccatctcactgggacatgggacaccctgattgaacgggagaacgctgttgcttattgctaccccggtgctacagttaatgaggaggcgttgcgtcagaagataatggaaagcgggggaatctcgaagattagcactggctttacctacgggaccagtattaatagcgcgggaaccacaaaagcctgcatgagaaacggaggcaacagcttttacgccgaattgaaatggttagtgtcaaagaacaaaggacagaacttccctcagaccacaaacacgtacagaaacaccgatactgctgagcacttgattatctggggcattcatcacccatctagcacacaagagaaaaatgatctgtatggaacccagtcactgagcatctcagtcggcagttccacttaccaaaataattttgttcctgtggtgggagcacgcccacaggtgaatggacagtctggaaggattgattttcactggaccctgttgcagccaggagacaatataaccttcagtcataacgggggcctcatcgcgccgtctcgggtgtcaaagttgattggaagaggactcgggattcaatccgaagcccccatcgataatggctgtgaatctaaatgcttttggaaaggtggttcgatcaatacaaagctgcccttccaaaacctttccccgcggacagttggacaatgccccaagtacgtgaacaagcgcagtctgatgctcgccaccgggatgagaaacgtgccggagattatgcatggcaggggcctgttcggagctatcgctggattcattgaaaacgggtgggagggcatggttgacggctggtatggattcaggcatcagaacgcacaggggacaggccaggcagctgactataagagtacccaggccgctatcgaccaaataacaggtaagcttaaccgtcttatcgaaaaaactaacacagagttcgaatcaatcgaaagcgaattcagtgagattgaacaccagattggtaacataattaattggacaaaagactctatcacagatatttggacctaccaggcagaactgctcgtggccatggaaaaccagcacactatcgatatggcagattccgaaatgttaaacctgtatgagcgagtgcgaaaacaactgcgccaaaatgcagaggaagacgggaaaggctgttttgaaatttaccatgcgtgcgacgattcttgtatggaatccatcagaaacaacacatatgatcactctcagtatagagaagaggctcttctgaatcgcttgaatataaaccctgtgaagttaagttcagggtataaagatatcatcctttggttctctttcggggcttcttgtctgatcttgcttgctgtggtcatgggtctcgtgtttttttgtctgaaaaacggcaacatgcgatgtacaatttgtatt

SEQ ID NO: 838 - DNA, 1683 bp, Influenza A virus
  misc_feature (1)..(1683): Codon Optimized Sequence Encoding H10 Hemagglutinin
atgtacaagattgtagtcatcatcgccctactgggtgcagtcaagggactggacaaaatatgcctgggccatcatgcagtggccaacgggaccattgttaagacacttacaaatgagaaagaagaggttactaatgccaccgaaactgtggagtccaccggcctaaaccgactctgcatgaagggaaggaaacacaaagatctgggaaactgccaccccatagggatgctcatcggctctcccgcatgtgacctgcatctgacaggaacctgggataccctgatcgagagagaaaacgcgatcgcctattgttaccccggcgcgacagtgaatggtgaggctctgcgccaaaaaataatggaatcaggaggaatagacaaaatttcaacaggatttacatacgaatcctccattaatagcgccggcacaactagagcttgtatgcggaatgggggcaattccttttacgcggagctgaaatggttggtatctaaaagcaaaggacagaacttccctcagactaccaacacctatcgaaatacagacacagccgagcacttaattatgtgggggatacatcacccctcttctacacaggagaaaaatgacttatacggaacccaatccttaagcattagtgtgggcagcagcacatatcgaaacaattttgtaccagtggtaggagctcgccctcaggtgaatggacagagcggccggattgatttccactggacactggttcagcctggcgacaatatcacattcagccataacggtggtttgattgctccttccagagtcagtaaattgatcgggagaggactggggattcagtcagacgcccccattgataataactgtgaaagcaagtgcttttggagaggtggatccatcaacacacgtctgcccttccagaacctgagtccccggacagtcggtcagtgtccgaagtacgtcaacaaacggagtttaatgctcgcgactgggatgaggaacgtgcctgaacttatgcaaggccggggcttattcggggccattgcgggctttctggaaaacgggtgggaagggatggttgatgggtggtacgggttcagacaccagaatgctcagggcaccggacaagccgcagattataagtcaacccaggccgcaatagatcagattaccggcaaactgaacaggctcgtcgagaaaaccaatactgagtttgaatctattgaaagcgagttttcagagattgaacatcaaatcggcaatgtgattaattggaccaaagattcgattacagatatatggacctaccaggctgaacttcttgtcgccatggaaaaccagcatacgatcgatatggccgacagcgaaatgttaaacctatacgagcgggtgaggaagcagctgaggcagaacgcagaagaggacgggaaaggctgttttgaaatataccacgcctgtgatgattcttgcatggagtcgatccgtaacaacacatacgaccattctcaatatcgagaggaagcattattgaacaggttaaacatcaatcccgttactctctccagcggatataaagacattatcctttggttttcattcggagcatcctgttttgtcttactagccgtcgtaatgggtttagtcttcttttgccttaagaacgggaatatgaggtgtaccatatgtatt

SEQ ID NO: 839 - DNA, 1683 bp, Influenza A virus
  misc_feature (1)..(1683): Codon Optimized Sequence Encoding H10 Hemagglutinin
atgtataaaatcgtggtgatcatcgctcttcttggcgctgtgaaggggctcgacaagatctgcttaggtcatcacgcagtggctaatggtacgatcgtgaagacactgacgaatgaacaggaagaagtcacaaatgccacggagaccgttgagagcactggcatcaatagactgtgcatgaaaggacgcaagcacaaggacctgggcaattgccatcctatcggcatgctgattggaacgccggcgtgtgacctgcatttgaccgggatgtgggataccctaatcgagagggagaacgcaattgcctattgttaccccggcgcaaccgtgaatgtggaagccctgcgacaaaagatcatggagagtggtggcattaataagatttctaccgggttcacttatggcagtagcatcaactctgccggcacaaccagggcttgtatgaggaatggaggcaacagcttttatgctgaacttaaatggctcgtcagcaagtctaaaggtcagaacttccctcagaccacaaatacatacagaaatactgacacagccgagcacctcatcatgtggggcatccatcatccatcttccacccaagagaaaaacgacctctacgggacacagagcctgtctataagcgtgggctctagcacttatagaaataatttcgttccagtggtgggcgcacgtccccaagttaacggccagagcggaaggatcgatttccattggactctggtgcagcctggggacaacattacattttcccacaatggaggtcttattgcaccctcacgggtatccaagttaatcggccgcggacttggcatccaatcagatgcacccatcgacaacaattgtgagagtaagtgcttctggcgtggtgggagcatcaacacgagattacctttccagaatctgagcccgagaacagtagggcaatgtccaaagtatgtgaacaggcgcagcctcatgctcgcgaccggaatgagaaatgttcccgaactgatacaaggaaggggtttgttcggcgccatcgcaggatttctggaaaacgggtgggagggaatggtggacggttggtacggcttccgtcaccagaacgcccagggcacgggtcaggccgcagactataaaagtacccaggcggccattgatcagataacaggcaagctcaaccggctggtagaaaaaaccaatacagagtttgagagcatagagtccgagtttagcgagatagaacatcaaataggaaatgtcatcaactggaccaaggacagcatcacggatatttggacttaccaggccgaattactggttgctatggagaaccagcacactattgatatggcagattctgaaatgttaaacttatatgaacgcgtgagaaagcagttgaggcagaatgctgaggaggacgggaagggctgctttgaaatataccatgcctgcgacgatagctgtatggagagcatcaggaacaatacatacgatcacagtcaataccgcgaggaggctttactcaaccggctcaacataaaccccgtcactctctcttcgggctacaaggatattattctgtggttttcattcggcgcttcctgcttcgttctcctagccgtagtaatgggcctcttcttcttctgcctgaaaaacggcaacatgcggtgtactatctgcatt

SEQ ID NO: 840 - DNA, 1683 bp, Influenza A virus
  misc_feature (1)..(1683): Codon Optimized Sequence Encoding H10 Hemagglutinin
atgtacaagattgtggtcatcatcgccctgctgggcgccgtcaaggggctcgataagatttgcctaggtcaccacgccgtcgccaatggcacgattgttaaaacactgaccaatgaacaggaggaagtgactaacgctacggaaacagtggaatctacagggattaacagactttgcatgaaggggcgcaagcataaggaccttggaaattgccacccaatcggaatgcttatcggaacacctgcttgtgaccttcatctgaccggcatgtgggacaccctgatagagagggagaacgccatcgcctactgctatcctggagccaccgtcaatgtcgaagccttaagacagaaaataatggaaagtgggggtataaacaaaatcagcactggcttcacttatggttcttctatcaatagcgcagggacaaccagagcctgcatgcgcaatgggggcaatagcttttatgccgaactgaagtggctggtctctaaatctaagggtcaaaattttcctcagacaaccaacacataccgcaatacggacaccgcggagcatctcattatgtgggggattcaccacccttcaagcacccaggagaagaatgacctctatgggacacagagcctgtcaatctcagtgggatctagcacttatcgtaacaatttcgttccagtagttggtgcacgcccccaggttaatgggcagagtgggcgaattgatttccactggacgctcgtgcagcccggcgataatatcacattcagtcacaatggggggctaatcgccccgtccagagtttctaagctgatcggcagaggattaggaattcaatccgacgcacccattgacaacaattgtgaatcaaaatgcttctggcgcggagggtcgataaacacacgacttccttttcaaaacttatccccaagaaccgtgggacagtgccccaagtacgtcaatagaagatcactgatgctggccaccggtatgaggaatgtgcccgaactaatccagggccgcgggttgttcggcgctattgcaggctttttagaaaacggctgggaagggatggtcgacggatggtacgggttcaggcatcagaatgcgcagggcactgggcaggccgcggattataagagtacccaggcggccatagatcaaataaccggcaagctcaacaggctggtcgagaagacaaacacagagtttgagtcaatagagtccgaattctccgaaatcgaacaccaaataggcaatgtgataaactggaccaaggactccatcaccgatatctggacttatcaggctgaactgttagtggcgatggaaaaccagcacacaatcgatatggcagactcagagatgcttaatctgtatgaacgagttagaaagcagctccggcagaatgccgaggaagacggaaagggctgcttcgagatctaccacgcgtgcgatgattcctgtatggagtctattcgcaataacacgtatgatcattcacagtatagagaagaggccctcctaaacaggctcaacatcaaccctgtgacgctgtcgagcggctataaggatattatactgtggtttagtttcggcgccagttgctttgtccttcttgccgtggtaatgggattattcttcttctgtctgaaaaacggaaacatgagatgcacaatatgtatc

SEQ ID NO: 841 - DNA, 1683 bp, Influenza A virus
  misc_feature (1)..(1683): Codon Optimized Sequence Encoding H10 Hemagglutinin
atgtataaaattgtagtcattattgccttgttaggtgcagtgaagggcttagacaaaatatgcctaggtcatcacgccgtcgctaatggtacaatagtcaagaccctcaccaatgaacaggaggaggtcacgaacgcaacagagaccgtggagtccacaggaataaaccgactgtgtatgaagggcagaaaacataaagacttgggcaactgtcaccctataggcatgttgattggcacaccagcttgtgatctccacctaaccgggatgtgggacaccctcatagaacgcgagaacgctatcgcctattgttatcccggggccacggttaatgtggaagctctgcgacagaagatcatggagagcggggggattaataagataagcactggtttcacctacggctcaagtatcaattcagctggcaccacccgagcatgtatgaggaatggcggaaatagcttttatgcagaactgaagtggttagtcagtaaaagtaaaggtcagaactttccacagaccaccaacacatatcgcaatactgatacagctgagcacttaatcatgtggggaattcaccatcccagttccacacaagaaaaaaatgatttatacggcactcagtccctttcaatcagcgtggggtcctctacctacaggaataactttgtccccgtggttggcgccagaccccaggtaaacggtcagtctggacggatcgatttccactggacactggtgcagccaggtgacaatattaccttcagccacaatgggggcctgatcgccccctcaagagtgtccaagctgatcggaagagggttggggatccagtccgatgccccaatcgacaataactgcgaatccaaatgtttctggcgcggaggctcaataaataccagactccctttccagaacctttcaccaagaacagtcggacaatgccctaagtatgtcaatcgccgatcgctaatgcttgcgacagggatgagaaatgtgccagagctgattcaagggcgcgggctgttcggcgctatcgccggctttttagagaatggttgggaagggatggtggatggctggtatggatttaggcaccagaacgctcaggggacagggcaggctgccgactataagagcacacaggcagccattgaccaaatcactgggaaattgaaccgtcttgtggaaaaaactaacaccgagttcgagtccattgagtccgagttctcggagatagaacaccaaatcgggaacgtcatcaattggacaaaagattccatcaccgatatctggacttaccaggctgagttgctggtcgctatggagaaccagcacacgatcgacatggcagactctgagatgttgaacctgtatgagagagtgcgaaaacagctcagacagaacgctgaagaagacggaaaggggtgcttcgagatctatcatgcctgtgacgatagctgtatggagagcataagaaacaatacgtatgatcactctcagtacagagaagaggccctgctaaatcggttaaacattaatccagtgaccctgagcagcggctacaaggacatcatcctatggttttctttcggtgcctcgtgcttcgtcttactcgctgtcgtcatgggtctgttcttcttttgcctgaagaacggcaatatgcggtgtacaatctgtatt

SEQ ID NO: 842 - DNA, 1683 bp, Influenza A virus
  misc_feature (1)..(1683): Codon Optimized Sequence Encoding H10 Hemagglutinin
atgtataaagtggtcgtgattattgctctgttaggcgccgtgcgcggcttggataagatctgcctaggccatcacgccgtcgctaacggcactaccgtaaagaccctgaccaacgagcaggaagaagtcacaaatgctaccgagaccgttgagagcacttcgttgaacaagttatgcatgaagggcagacgctacaaggatctgggtaattgccaccccatagggatgctcattggaacgcccgtctgtgacttgcatttgaccggcacatgggataccctcatcgagcgggaaaacgccacagcatactgctatcctggggtgactatcaacgaggaagcattgaggcaaaagatcatggaatcaggcgggatcagtaagatgagaaccgggttcacctacgggccttccatcaactccgccggcaccacccgcagttgtatgagaaacggcggcaattctttttatgctgagctgaagtggttggtctctgggaccaagggccaaaattttcctcaaacaacgaatacctaccggaatactgacacggctgaacatctgatcatctgggggattcaccacccctcatccacccaagagaagaatgatctgtatggaacgcagagcctgtctatttcggttggaagcagtacataccagaataacttcgtgcccgttattggggcccgtccccaggtcaacggtcagtcgggccggattgagttccattggaccctggtccgccctggtgacaacattactttttcgcataacggtgggctaatcgcacctgatcgagtgtccaagctgatcggcaaaggaattggtatacagtctggtgcggtaatcgataaggactgtgaaagcaaatgcttctggagaggcggcagtatcatcaccgaactcccctttcagaatctctctccacgtacagtgggccagtgtccaaagtatgttaaaaagcggtctctgttactagccacggggatgaggaatgttcccgaggtggtacaaggacggggcctcttcggggcgatcgccggcttcattgaaaacggctgggagggtatggttgacggatggtacggattccgccaccaaaacgcccagggaatcggccaggctgccgactacaaatccactcagaccgccatcgaccaaattacgggtaaactgaaccgcctaatcgagaagacaaatactgaatttgagagcattgagagtgagttcagcgaaatcgagcaccagatcggaaatgtgattaattggacaaaggatagtattaccgacatctggacctaccaggcggagctccttgtggctatggaaaaccaacacaccattgacatggccgacagtgaaatgctgaatctctacgagcgcgtgagaaagcagctccggcagaacgccgaggaggacggcaaaggatgcttcgaaatatatcacacatgtgacaactcatgcatggaaagtattaggaacaacacctacgaccattcccaatacagagaggaggccctacttaaccgccttaacatcaatcccgtgaaactctcctccggttataaagatatcattttatggttcagcttcggggcgagttgctttgtgctgctggctgtgattatgggcctgggattcttttgcctaaaaaacggaaacatgcgatgcactatctgtatc

SEQ ID NO: 843 - DNA, 1683 bp, Influenza A virus
  misc_feature (1)..(1683): Codon Optimized Sequence Encoding H10 Hemagglutinin
atgtataaaattattgtgatcattgcactgctgggggccgttaagggtctggacaaaatttgtctaggacaccacgctgtggcaaacggtactatcgtgaaaacattgaccaacgaacaggaggaggttaccaacgccaccgagacagtcgaaagtaccggaattaatcgcctctgcatgaaaggccgaaagcataaggacctggggaattgccatcccatcggaatgctgatcggcaccccagcctgtgacttgcatcttacaggaacctgggacacactaatcgaaagggaaaacgccattgcttactgttacccgggcgctacagttaacgtggaggcccttaggcagaaaatcatggagtccggcgggatcgacaagatcagtaccggcttcacctatgggtcaagcatcaattctgcgggcactacgagggcatgcatgaggaacggaggcaactcattctatgcggaattgaagtggctggtctccaagtccaaagggcagaacttccctcaaactactaacacctaccggaatacagacacagcggaacacctcattatgtggggcatccaccacccttctagtactcaagagaagaatgatctctacggcactcagtccctgagtattagtgtcggctcaagcacctatagaaacaatttcgtgcccgttgtgggggcccgccctcaggttaatggtcaatcagggcgaattgattttcactggaccctggtccagcccggggacaacataacattcagccataatgggggtctgattgcccccagccgggtgagcaagttgatagggaggggacttggcatccagagtgacgcccctattgacaacaactgcgaaagcaaatgcttttggcggggtggctcaataaacacaaggctacccttccaaaatttgagtccaaggaccgtgggtcaatgccctaaatacgtcaatcgccgctccttgatgctcgccactgggatgcgcaacgtgcctgagcttattcagggtcggggtctgttcggggctatcgccgggttccttgaaaatggctgggagggtatggtagacggctggtacggatttagacaccagaacgcccagggaacgggccaggcggcagactacaagtctacccaagctgcaatcgatcagatcactggcaagttaaacagactggtggaaaagacaaataccgaatttgaaagcattgaatcggaattctcagagatcgagcaccagattggaaatgtgattaattggacgaaagacagtattaccgacatctggacttatcaggcagaactgctggttgccatggaaaaccagcataccatagatatggcagattctgaaatgctcaatctttacgagcgcgtacggaaacagttaagacagaacgcagaggaggacgggaaaggttgctttgaaatataccacgcatgtgacgattcttgcatggaaagtatccgcaataatacgtatgatcacagtcaataccgagaagaggctctcttgaatcgtttgaatatcaatccagtgaccctgtcctccggatataaggatataattctgtggttcagttttggggcaagttgcttcgtcctcctcgctgtcgttatgggactgttttttttttgtctaaagaacggaaacatgcgctgcactatatgcatt

SEQ ID NO: 844 - DNA, 1683 bp, Influenza A virus
  misc_feature (1)..(1683): Codon Optimized Sequence Encoding H10 Hemagglutinin
atgtataaaatagttgtcatcattgcactcttgggcgccgtgaaaggactggataaaatatgtctcggccaccatgcagttgcaaacgggacaattgtgaaaacattgaccaacgagcaggaggaggtgaccaatgctacagagacggtggaatctactggcatcaaccgattgtgcatgaaaggtaggaaacacaaggatttgggtaattgccatccgattgggatgcttatcggaaccccagcttgcgatctgcatttgaccggaatgtgggacaccctgattgagagggaaaacgccatcgcctactgctatcctggcgcaacagttaacgtggaggcacttcgccagaagatcatggaaagcggggggataaacaagatctctacaggtttcacctatggttcttccattaacagcgccggtaccacacgagcttgtatgcgaaatgggggcaactccttctacgctgaattaaaatggctggtgtcgaagtccaaagggcagaacttccctcagacaacaaacacctaccggaacacagacaccgcggagcacctgatcatgtggggtatacaccaccccagctctacccaggaaaagaatgatctctatggaacccagtcattaagtatcagcgtcggttcctctacatatcgtaataatttcgtgcctgtggttggcgccaggccacaagtgaatgggcagtccggcagaattgactttcattggactctggtgcagccaggcgacaatatcacattctctcacaacgggggacttatcgccccctccagggtgtcaaaactcatcggccgggggctgggaatccaaagcgatgctcccatcgacaacaattgcgaatcaaaatgtttctggcgagggggttccataaataccagactgccattccagaacctgtccccaagaacagtgggccaatgtcccaagtatgtgaacagaaggtctttgatgctcgcaactgggatgcgaaatgttccagagctgattcagggtcgaggactttttggagccatcgctggcttcttagagaacggctgggaaggaatggtggacggctggtatggctttagacaccagaacgcccagggtacgggacaggctgcagattacaaatctacacaggccgcaatcgaccagatcacaggcaagctcaatcggcttgtggagaagacaaacacagagtttgagagcattgaatcggaatttagtgagattgagcaccagattggcaatgtgattaattggactaaagactctattacggatatctggacgtatcaggcagagctgttggtggcaatggaaaatcaacacactatcgacatggccgatagtgagatgctcaatctatatgagagggttcgcaagcagctgcgtcaaaatgccgaggaggatggcaagggatgtttcgagatttatcacgcctgcgatgattcgtgcatggagagcattcgcaataacacgtacgatcactctcagtacagggaggaggcacttttaaaccgtctcaacatcaaccctgtgaccctgagctctggctacaaagacatcattttgtggttctcctttggagccagctgcttcgtgctcctcgccgtggtcatgggcttgtttttcttctgtctgaagaatggaaatatgcgatgcaccatctgtatt

SEQ ID NO: 845 - DNA, 1683 bp, Influenza A virus
  misc_feature (1)..(1683): Codon Optimized Sequence Encoding H10 Hemagglutinin
atgtacaaggtggtagttataatcgcacttctgggagcagtgagaggtctcgacaagatttgcctcgggcaccacgctgtggctaatggcacaattgtgaagaccttgacaaatgagcaggaagaagtgacaaatgcgactgagactgtcgagtccaagtctctgggcaagttgtgcatgaagggcagatcctacaacgacttagggaactgtcatccgatagggatcttaatcgggaccccagcctgcgatctccacctgactggcacctgggataccttaatcgagagggaaaacgcagtggcctactgctatcccggtgctaccgtgaatgaggaggctctgaggcagaagatcatggagtcagggggaatttcgaaaataagcaccgggttcacttacggtaccagcatcaattctgctggaacaactaaggcatgtatgcgtaatggcggaaactcattttacgcagagctcaagtggctagtgagcaagaataaagggcagaactttccgcagaccactaacacttacagaaacacagataccgctgaacatttgattatctggggcattcaccacccgtcgtcaacacaggagaagaatgatctgtatggtacacagtcactgtcaatttctgtcggatcttccacctaccagaataatttcgttccagtggttggtgctaggccccaggttaacggacaatccggtcgcattgacttccattggaccctgctgcagccaggcgataacattacgttctcgcataacggcggcctaatcgcacctagcagagtgtcaaagttgattgggaggggccttggcatccagagcgaggcccccatcgacaatggctgcgagtccaaatgcttctggaaaggggggtcaatcaacaccaagctgccctttcagaacctcagcccccgaaccgtcgggcagtgccctaaatacgtgaataagcgcagtctgatgttagctacagggatgcggaatgtacccgaaatcatgcacgggcgaggtctgttcggggcaattgcaggcttcattgaaaatgggtgggaaggcatggtcgatgggtggtatgggtttagacaccaaaacgcacaaggaacaggccaggcagcggactataagagcacccaggcagctattgaccagattaccggcaagctgaacaggcttatagagaagactaacacagaattcgagtccattgagtcagagttcagcgagattgagcaccagatcggaaacatcattaactggactaaggactcaattacagatatatggacgtatcaggccgaactgttggtggcaatggagaatcagcataccattgatatggcagatagtgagatgctgaatctttacgaacgcgttcgcaaacagttgcggcagaatgccgaagaagacggcaagggttgctttgagatataccacgcttgtgacgattcctgcatggagtctatcagaaacaacacgtacgatcacagtcagtatcgcgaggaggcattactcaatcgactaaatatcaacccggtgaaactgtctagcggatacaaagacatcatcctttggttttcctttggcgcaagttgtttgattctgttggccgtggttatgggtttagtctttttttgtctcaaaaacggtaatatgcgctgtacgatctgcatt

SEQ ID NO: 846 - DNA, 1683 bp, Influenza A virus
  misc_feature (1)..(1683): Codon Optimized Sequence Encoding H10 Hemagglutinin
atgtacaagatcgtggtcatcatcgccttgttgggggcagtgaaaggattggataaaatttgcctgggacaccacgccgtcgccaatggaaccatagtcaagacgctgacaaacgagcaggaggaagtaaccaatgcgactgaaaccgtggaatcaaccggaatcaatcgactgtgtatgaaaggcaggaagcataaagacctgggcaactgtcacccgatcgggatgttaatcgggacacccgcttgtgacttgcacctgaccggcatgtgggacactctgattgagcgagagaatgcaatcgcctattgttaccccggagccactgttaacgttgaggccctcagacagaagattatggagtctggcgggatcaacaagatctccacagggtttacttacggaagcagcatcaactctgccggcactactcgcgcttgcatgcgtaacgggggtaacagcttctatgctgaactcaaatggctggtgtctaaaagtaagggccagaactttccgcagacgactaatacatatagaaataccgatacagccgagcacctgattatgtgggggatacaccaccccagttccacccaggaaaagaacgacctatatggaacccagtccctctctattagcgtcggctcttcaacttatcgtaataattttgtgccggtcgtcggagcaagacctcaggtcaacgggcagtccggtcgaatagattttcactggaccctagttcagccaggagataatatcacattcagccacaacggagggttgatagctccatcacgagtgtccaagctgatcggcagggggctcggcatccagtccgacgccccaattgataacaactgtgaatccaagtgcttctggagaggaggctctatcaatacccgattgccgttccaaaatctatcccctagaacagtcgggcagtgccctaaatacgtgaatagaagaagcttaatgttggcaacaggaatgaggaacgtgccggaactcatccaggggcgcggcttattcggcgctatcgcaggttttcttgagaatggatgggagggcatggttgatggttggtacggattcagacaccaaaacgctcaaggcaccggccaagctgccgattataaaagcactcaagctgctatcgaccagattaccggaaaacttaataggctggttgagaaaacgaacaccgaattcgagagcatcgagagcgaatttagtgagatcgagcatcaaataggcaacgtgatcaattggacgaaagattctatcaccgatatttggacttatcaagccgaacttctagtggcaatggagaaccagcacacaatcgacatggcagattcggaaatgctgaatttatacgagagggtgcgtaaacagttaaggcaaaacgccgaagaggacggtaaaggttgctttgaaatttatcacgcgtgcgatgattcctgtatggagagtattcggaataatacatatgatcactcccaatatcgcgaagaggcattgttaaaccggctgaatataaatccagtaaccctgtcctccgggtacaaagacataatcctgtggttctccttcggggctagttgttttgttctgctggctgtggttatgggattattctttttttgtctgaaaaacgggaatatgcgctgtacaatatgcata

SEQ ID NO: 847 - DNA, 1683 bp, Influenza A virus
  misc_feature (1)..(1683): Codon Optimized Sequence Encoding H10 Hemagglutinin
atgtacaaaattgtagtgattatcgctcttctaggcgccgtaaaggggcttgacaagatctgtctaggacaccacgccgtggccaatggaaccattgtaaaaacactgacgaacgagcaggaggaggtgacaaacgccactgaaacagttgagagcaccgggattaaccgtctctgtatgaagggtaggaaacacaaagatctcgggaattgtcatccaattggaatgctgataggcactcccgcctgtgaccttcacttaactggcatgtgggacacactgatcgagagggagaatgcaattgcgtattgttacccgggcgccactgttaatgtggaggcgctgaggcagaaaataatggagtccggcggaataaataaaatctctacggggttcacctacggatcctccatcaactctgcaggcacaacaagagcctgcatgagaaacgggggcaacagtttttacgccgagctgaaatggttagtcagtaaatctaaagggcaaaatttccctcagacgaccaacacctaccggaacaccgataccgctgagcatctcatcatgtggggtatccatcacccttccagcactcaggagaaaaacgacctgtacggtactcaatccctctctatctcagtcggaagctccacataccgcaataatttcgtgcctgtggtcggggcccgcccgcaggttaacggacagtcaggacggattgacttccactggactctggtgcagcccggtgacaacattacgtttagccataacggtggtctcattgccccgtcgcgtgtatccaagctgattggccgggggttagggattcaaagtgacgcacccatcgacaacaattgcgaatcgaagtgtttttggagaggcggcagtattaatacccggttgccattccaaaacctctccccaagaacagttggccagtgtccaaaatatgtcaaccggcggtcccttatgctcgccaccggcatgcgaaacgtacccgaactgatccaaggccgcggtctgtttggagctatcgcaggcttcctggagaacgggtgggagggcatggtcgacggatggtatggttttaggcaccagaatgcacaagggacgggtcaagccgccgattacaagagcacacaggcggccatcgaccaaatcactgggaaactgaatagactggtggagaagaccaacactgagttcgaaagcatcgaatcagaatttagcgaaatagaacaccagatcggcaatgtgattaactggacaaaggatagcataacagacatctggacatatcaggctgaactgcttgtcgcgatggagaaccagcacaccatagatatggcagatagtgaaatgctcaatttatacgagcgggtgagaaaacagcttagacagaacgctgaagaggacggcaaggggtgctttgagatataccacgcctgcgacgacagctgcatggaaagtatcaggaacaatacatatgaccactcacagtatcgcgaagaggcacttctcaatagactaaacatcaatcccgtgacactgagtagtggatataaagatattatattatggttctcttttggggcgtcatgtttcgtgcttctggccgtggtgatgggtctcttcttcttctgtcttaaaaatggcaatatgcggtgcaccatttgcata

SEQ ID NO: 848 - DNA, 1683 bp, Influenza A virus
  misc_feature (1)..(1683): Codon Optimized Sequence Encoding H10 Hemagglutinin
atgtacaaaatcgtactggtgctggcattgctcggggcagtgcacggcctggacaagatatgcctgggacaccacgctgtgcctaacggtaccattgtgaagactctgacgaatgagaaggaagaggtgacgaacgcaacggagacggtcgagtccaagagcctcgataagctgtgtatgaagaacaggaactacaaggacctcgggaattgtcatccaattggcatggtggtgggcactcccgcctgcgacctccatctgactggtacatgggataccctaatagagcgggacaatagtatcgcctactgttatcccggcgccaccgtgtcagaggaggccctgcgacagaaaataatggagtccggcggcattgataagatttccactgggtttacatacggtagctccattaattctgcgggaactaccaaggcttgtatgagaaatggcggtaactctttctatagcgagttaaaatggctggtgagcaagaataagggccaaaatttcccccagactacgaacacctacagaaacaccgacagtgttgagcacctgattatatgggggatacatcatcccagttctactcaggagaaaaacgatttatacggcactcaaagtctgagtatctctgtggggtctagcacataccagaacaacttcgtcccagtggttggggcaaggccgcaggtgaatggacaatcagggagaatcgatttccactggacaatggtacagcctggggataatatcaccttttctcataacggcggacttatagcccccaaccgcgtgagcaagctaaagggaagaggcctaggaattcaaagcggtgcttcggtggacaatgactgcgagagcaagtgcttctggaaaggtggctccatcaatactaagttgccttttcagaacttgagcccgagaaccgttggccagtgccctaaatatgtgaacaaaaagtcactcctgctcgccacagggatgaggaatgtccccgaagtggctcagggtcgcgggctcttcggagccatcgccggattcatcgagaacggctgggaagggatggtagacggctggtatggctttaggcatcaaaacgcccaggggacagggcaagccgctgactataagagtacccaggcagccatcgaccagatcactgggaaattaaatcggctgattgaaaagacgaacaccgaatttgaaagcatcgagtcagagttctccgagatagagcatcaaattgggaacgtgattaactggacgaaggatagcatcaccgatatttggacataccaggcggagctgctggtggccatggagaatcaacatacaatcgacatggccgactctgagatgttgaatctctacgaaagggtgagaaagcagttaaggcagaatgccgaggaggatgggaaaggatgcttcgagatctatcacaaatgcgatgacaattgtatggaatctattcgtaacaatacttacgaccacactcagtatcgtgaggaagcgctgttgaatcggctcaatatcaatccagtgaagctgtcatctggctacaaagatgtgatattatggttttcttttggggcatcttgcttcgtgctgctggctgtcattatgggacttgtatttttttgtttgaagaatggaaacatgcgctgcacaatctgcatc

SEQ ID NO: 849 - DNA, 1683 bp, Influenza A virus
  misc_feature (1)..(1683): Codon Optimized Sequence Encoding H10 Hemagglutinin
atgtataagatagtggtcataattgccctgctgggggcggtgaagggcctggacaagatttgtctgggtcatcatgctgtggcaaacggtacgatcgttaagaccctgacgaatgaacaagaggaggtgactaacgctaccgaaaccgtggagtccaccggcataaaccgcctttgcatgaaggggaggaagcacaaggacctcggtaactgtcacccaatcggcatgttaattggcacaccagcttgtgatctgcacctgaccggaatgtgggatacactcattgaaagagaaaacgctatcgcgtattgctaccctggagcaactgttaatgtcgaggctttgcgccaaaaaataatggaaagtggcggtatcaataaaatctcaacagggtttacctacgggagcagtatcaactcagccggaacaacccgggcctgcatgcgcaatggcggcaactctttttacgctgaactgaaatggttggtgtcaaaatcaaagggtcaaaactttcctcaaactacaaatacatatcggaacaccgatacagctgagcacttaataatgtgggggatccaccacccttcttcaactcaggaaaagaatgatctgtatggcactcagtcactctccattagcgtagggtcatctacctatagaaataatttcgtaccagtggtaggtgcaaggccccaggtgaacggccagagtggcagaatagacttccactggactcttgttcagccaggggataacattacattctcgcacaacggcggcctgatagccccatctagggtgtctaagctaattggcagaggtctgggcatccaatccgacgcaccaattgacaacaattgcgaaagtaagtgtttctggagaggagggtcaattaatacaagattgccgtttcaaaatctgtccccgagaacagtgggacagtgcccaaaatatgtaaatagacggtcactgatgttagctaccggcatgcgaaacgtccccgagctgattcagggtagaggcctgttcggagctattgcagggtttttggaaaatgggtgggagggcatggtggacggatggtacgggttccgacaccagaatgcccagggaaccggccaggcggctgactacaagtctacacaggcagcaattgaccaaatcaccggaaagttgaaccgccttgtagagaaaacaaacacggaatttgaatcaattgaatcagagttttccgagatagagcaccagatcgggaatgtcataaattggacaaaggattctattacggatatttggacctaccaagcagaactgcttgtggctatggaaaatcagcacaccatagatatggccgacagtgagatgctgaacctgtacgagcgggtaagaaagcagttgcgccagaacgcagaggaagacgggaaaggctgcttcgaaatctatcacgcctgtgacgactcatgcatggaaagtatcaggaataatacatacgatcattcccaataccgtgaggaagcactactcaaccggctgaatatcaaccccgttacactctcctcaggttataaagacataatcctgtggttctccttcggcgctagctgctttgtcctgttggccgtagtaatggggctgttcttcttttgccttaaaaacgggaacatgcgatgtactatctgcatt

SEQ ID NO: 850 - DNA, 1683 bp, Influenza A virus
  misc_feature (1)..(1683): Codon Optimized Sequence Encoding H10 Hemagglutinin
atgtacaaggtcgtagtgattatcgccctccttggcgccgttaaaggcctagacaagatctgtctgggacatcacgccgtcgctaatggcacaatagtgaaaacgctcactaatgagcaggaggaagtaaccaacgccacagaaacggtcgaatccaccggcataaatcggctttgcatgaaggggcgtaaacataaggacctggggaactgtcacccaatagggatgctgatcggaacacctgcttgtgacctccacctgacaggcacctgggatacgttgatcgagcgggagaacgctatcgcatactgctaccccggcgctaccgtcaatgtggaagcactgcgtcagaagataatggaatcaggaggcattgataagatctcaacagggtttacctacggctctagtatcaatagcgcaggtaccaccagggcatgcatgcgcaatggtggcaacagtttctacgcagagctgaagtggctggtgtctaaaaataaaggccagaacttccctcagaccacaaacacttaccgcaatacagatactgcagagcatctgattatgtgggggatccaccacccttcctccattcaagagaagaacgacctgtacggcactcagagcttatcaatatcggtgggttcctccacttaccgtaacaatttcgtccccgtagtcggggctaggcctcaggtgaatggtcagtcagggaggatagactttcactggacgctggttcagccaggcgacaatataaccttctcacacaacgggggtctgattgctccttctagggtgtcaaagctgatcgggagaggactgggtatacaaagcgatgcccccatcgataataactgtgaaagtaagtgtttttggcgcggagggagcattaacacgcggctgccttttcagaacctgtccccccggactgtgggccagtgtcccaagtacgtgaaccgcaggtcactcatgctagccacgggtatgagaaatgtgccagagttaattcagggccgcggtctgtttggggctattgcaggttttctggagaacgggtgggagggcatggtggacggttggtacggctttaggcatcagaacgcacagggtactggacaggcagccgattacaagagcactcaggcagcgatagaccagataactggcaagctcaaccgtttagtggagaagaccaacaccgaatttgaaagtattgagtccgagttctcagagattgagcatcagatcggcaatgtcattaattggacaatggattcgatcaccgatatatggacctatcaggccgagttgctggtcgccatggaaaatcaacacactatagatatggcagattccgaaatgctgaatctctatgagagggtgagaaaacaactgaggcaaaatgcggaggaagacgggaaaggttgcttcgaaatttaccatgcttgcgatgatagttgcatggagtccatccggaataacacgtatgatcacagccaataccgggaagaagccctgcttaaccggcttaacataaatcctgtgactctctcatcaggatataaggatatcatcctctggttctctttcggggccagctgctttgttttgttagccgtggtgatgggactcgtgttcttctgcttaaaaaacggcaatatgcgttgcaccatctgcatc

SEQ ID NO: 851 - DNA, 1683 bp, Influenza A virus
  misc_feature (1)..(1683): Codon Optimized Sequence Encoding H10 Hemagglutinin
atgtataagatcgtcgttattattgccctgcttggtgctgtcaaggggttggacaaaatttgcttgggccaccacgcagtggctaacggcactatagtcaaaaccctgacgaacgagcaggaggaggtgacaaacgccactgagaccgtggaatctacgggaatcaacaggctctgcatgaaggggcgcaaacacaaagacctcgggaactgccaccctatcgggatgctcataggtactccagcgtgtgacctgcacttaacaggcacttgggatacccttattgaacgggaaaatgctatcgcttactgctacccgggcgcgaccgccaacgtggaagcattacgccaaaagataatggaatcaggcggcatagataaaatctccaccggatttacatacgggtctagcataaattctgccggcaccactagagcctgtatgagaaacggcggaaattcattctacgctgagctgaaatggctggtctcaaagtctaaggggcagaatttcccccagaccacgaatacgtaccggaacacagataccgccgagcatctgatcatgtggggaatccatcaccccagttcaatccaggagaagaatgacttatacggtacacaatccctgtccatatcagtaggtagctctacatatcggaacaatttcgtgcctgtcgtcggggctaggcctcaggtaaacggccagtccggtagaatcgattttcactggaccctcgtccagcctggggacaatataacgtttagtcacaacggaggtctcatcgcccccagccgggtatctaagcttattggcaggggcctgggtattcagagcgacgccccaattgacaataattgcgaaagcaagtgcttctggaggggtggaagtattaacacaagactgcctttccaaaacctgagccctagaactgtgggacagtgcccaaaatacgtcaacaggagatcacttatgctggcgacaggaatgcgcaatgtacctgaacttattcaagggcgaggactgtttggtgccatagctgggttcctggaaaacggttgggagggaatggtggacggctggtacgggtttagacaccaaaacgcacaaggaaccggccaggctgccgattataagtccacacaagcagccatcgatcaaattaccggtaagctgaatcggttagttgaaaaaaccaataccgagtttgaatccatcgagagtgagttctcagagatcgagcaccagataggcaatgtgatcaactggacaatggattcaattaccgatatctggacctaccaggctgagctgctggtggccatggaaaatcagcatacaattgatatggccgacagtgagatgctgaacttgtatgaaagagttagaaaacagctgaggcaaaatgccgaagaggatggcaagggatgttttgaaatctatcatgcgtgtgatgatagctgtatggaatccatcaggaacaatacatacgatcactcacagtatagagaagaagcactcctgaacagattaaatatcaatccagtgaccttatcatctggctacaaggatataattctttggttttcgtttggggcttcctgcttcgtgttgctggccgtggtcatgggtctagtgtttttttgcttgaaaaacggaaatatgcggtgtaccatctgtatc

SEQ ID NO: 852 - DNA, 1683 bp, Influenza A virus
  misc_feature (1)..(1683): Codon Optimized Sequence Encoding H10 Hemagglutinin
atgtacaagattgtggttataattgcgcttctgggagctgtgaagggattggacaagatctgccttgggcaccatgccgttgcaaatggtaccattgtgaagacgctgaccaatgagcaggaagaggtgaccaatgctacagagacagtggagtccactggcatcaaccgactctgtatgaaaggtagaaaacacaaagatctcggcaattgccatcctataggtatgctgattggtacgcctgcctgtgacctccatctgactggcatgtgggacacgctgatcgaaagggagaatgccattgcgtactgttatcctggcgctacggtgaacgtggaagccttacggcagaagatcatggaatccggcgggatcaataagattagcaccggattcacttacggatcttctatcaacagcgctggcaccactagggcatgcatgagaaacggcgggaatagtttttacgctgagcttaagtggttggtttctaagagtaagggacagaacttccctcagaccactaatacctacaggaacaccgacaccgcagagcatttaatcatgtggggaatccaccatccatcctccactcaggaaaagaatgacttatacggaacacagagcctttccatatctgtcggttcctccacatatagaaataattttgtgcccgtggtcggtgcacgacctcaggtgaatggccagtcaggaagaatcgattttcactggaccctggtacagcctggcgacaatatcaccttcagccataacggcggtctgatcgcccctagtcgggtgagtaaattgataggtcggggactgggaatccagagtgatgctcctattgataataattgcgagtcaaaatgtttttggcgcggcggctctattaacaccagattacctttccagaacctgagccctcggactgttggacagtgtcctaaatatgtgaatcgcaggtctctgatgctggctacaggcatgaggaacgtgcctgagctcatccagggaagggggctgttcggggccatcgctggattcctggaaaacggatgggagggaatggtcgatggttggtacggttttcggcatcagaatgctcaagggacgggccaggcggctgattataagtcaacgcaggcggccatagaccagatcaccggaaagctcaaccgcctggtggagaagacaaatacagagtttgagtctatagagtccgagttttccgaaatcgaacaccagatcgggaatgtgataaactggaccaaagattctatcactgacatttggacttaccaggcagaactattggtggccatggaaaatcagcacaccatcgacatggccgactctgaaatgctgaacttgtatgagagagtgcgcaagcagctgcgacaaaatgccgaagaagacggaaagggctgttttgaaatctatcatgcttgtgatgactcttgcatggaatctattaggaacaatacctatgatcattctcagtaccgggaagaagcattgctgaaccgcttgaatataaacccagtgacgctgtcatctggttataaagacattatcctgtggtttagctttggtgcctcatgctttgtactcctagccgtagtcatgggcctgtttttcttctgcctgaagaacgggaacatgcgatgcactatttgcatc

SEQ ID NO: 853 - DNA, 1683 bp, Influenza A virus
  misc_feature (1)..(1683): Codon Optimized Sequence Encoding H10 Hemagglutinin
atgtacaagatcgtggtgatcatagccttactgggggccgtaaaaggtctggataagatttgtctgggccaccacgctgtcgccaatggtaccattgtgaagacactaaccaacgagcaggaggaggtcacaaacgctaccgagacggttgaatctactggtataaaccgcctttgcatgaagggacgcaaacataaggatctggggaactgtcaccccattggtatgctgatcggaacccctgcatgtgacctacacctgaccggaatgtgggataccttaatagagcgagagaacgcgatcgcctactgttatccgggggctacggtgaacgttgaggctctgaggcagaagataatggaaagtgggggcatcaacaagattagtaccggattcacttatggtagtagcattaatagtgctgggactaccagagcatgtatgagaaatggcgggaacagcttctatgccgagctgaagtggctagtgagcaagagcaagggccaaaactttccccaaacgaccaacacataccgcaataccgatacagcagagcatctcataatgtggggaatccaccaccctagttcaacccaggagaagaacgatctttatggaactcagtccctgtctatcagcgtggggagttctacatatcgcaataactttgtgccagtcgtgggggcccgaccacaggtaaacggtcagtctggtcgaattgactttcattggaccttggtccagccgggcgataatatcacattttcccataatggaggcctgatagccccttccagagttagcaaattgataggccgaggactcgggatccagagcgatgcacccatcgacaacaactgcgagagcaaatgcttctggcggggcggaagcattaacactagattacccttccagaaccttagtcctcgcaccgtgggccagtgccctaaatatgtgaaccggcgctcactgatgctggccacaggcatgaggaatgtccccgagctgatccagggcagaggactcttcggtgctatcgcaggatttcttgagaacggatgggaaggaatggtagacggatggtacgggttccgacatcagaacgctcagggcactggccaagcagccgactacaaatccacacaggcggccatcgatcagataacaggcaaactgaatcggctagtagagaagaccaacaccgaattcgaatcaatcgagtctgaattcagcgagatagagcaccaaatcgggaatgtgattaactggacaaaggattccataaccgacatttggacctaccaagccgaactgctggtcgcgatggaaaaccaacataccatcgacatggcagactccgaaatgctgaatctgtacgaacgtgtgcggaaacagctgagacagaatgctgaagaagacgggaaaggctgttttgaaatctaccacgcctgcgacgactcatgcatggaaagcatcaggaataacacttatgaccattcccagtaccgggaagaagcactcctgaaccggttgaacattaatccggttaccttgagctctggatataaagacatcatcctatggttcagcttcggcgcatcctgctttgttctgcttgcagtggtcatggggctgttctttttttgcctgaagaatggcaacatgagatgtaccatttgcatc

SEQ ID NO: 854 - DNA, 1683 bp, Influenza A virus
  misc_feature (1)..(1683): Codon Optimized Sequence Encoding H10 Hemagglutinin
atgtataagatagtagtcatcatagctctcttgggcgccgtgaaagggctggacaagatctgtctgggtcatcatgccgtggccaacggaacaatcgtgaaaaccttgactaatgagcaggaggaggtgaccaatgcgaccgagaccgttgaaagtacgggcattaataggctctgtatgaagggtaggaaacataaggaccttgggaactgtcaccccattggaatgctgattgggactcctgcatgtgacttacacttaacaggcatgtgggacactctgattgagagggagaacgccattgcctattgttatcccggcgccaccgtgaacgtggaggcactgcggcagaagataatggaaagcggagggattaataaaatcagcaccggattcacttatggtagttctattaattccgccgggacaacaagggcatgtatgaggaacggaggtaattccttctacgcggagctgaagtggctggtctctaagtccaaggggcagaactttccccagactacaaacacctaccgaaatacagataccgctgagcacctgatcatgtggggaattcatcacccttcatcaacacaagagaagaacgacctgtacggcacacagtcactgtcaatctcagtagggagctcgacatatagaaataatttcgtcccggtggtgggcgctcggccgcaggttaatggccagagtggtagaatcgactttcactggacgctggtccagccaggcgataatatcacgttctcacacaatggaggcctgatagccccaagccgcgtgtccaagctgatagggcgaggacttggtatccagagtgatgcccccatcgataacaactgcgaatccaagtgtttctggcgtggcggctcaattaacacccggcttccattccagaaccttagcccccgcactgtcggacaatgcccaaagtatgtcaacaggcggagcctgatgctggccaccggcatgagaaatgtgcctgagctcattcaggggcggggcctttttggggcaatcgctggctttctcgagaatggttgggagggaatggttgacggctggtatggctttagacatcagaatgcccagggaacgggccaggctgctgactacaagtccacccaggccgccatcgaccaaattaccgggaagctgaatagactcgtcgaaaagaccaacactgaatttgagagtatcgagtctgagttttccgagatcgaacatcaaatcggaaacgttatcaactggactaaggactcaatcaccgacatttggacatatcaagcggagctcctggtggccatggaaaatcagcacacgatcgacatggccgacagtgagatgctgaatctgtatgagcgagtccgtaagcagcttaggcagaacgctgaggaggatggaaaaggatgtttcgagatatatcacgcctgtgatgactcctgtatggaatccatcaggaacaacacatacgatcatagtcagtacagggaagaagccttgctaaataggttgaacatcaaccctgtcactctgagttctggatacaaggacatcatattatggttttcctttggcgcctcctgcttcgtcctgctagcagtggtgatgggcctgttttttttttgccttaaaaatggcaatatgcggtgcaccatttgcata

SEQ ID NO: 855 - DNA, 1683 bp, Influenza A virus
  misc_feature (1)..(1683): Codon Optimized Sequence Encoding H10 Hemagglutinin
atgtataagatcgttgtcatcattgctctcctcggagccgtgaaagggctcgataagatctgtttaggacaccatgccgtggcaaacggtactatagtcaagaccctaacaaatgagaaagaggaggtgacgaatgccacagaaacagtagaatctacaggactgaaccggctgtgcatgaagggccgcaaacacaaggatttaggtaattgtcacccaataggcatgttgattggaagtccggcatgtgacctgcacttgacgggcacatgggataccctgatagaaagggagaacgctatcgcctactgctatccgggagccacggtcaacggggaagcgctgcggcagaagattatggagtcgggcggtatagataagatatccacaggctttacctatgaatcctctattaactcagctggtacaactcgcgcttgcatgaggaacggggggaacagtttctacgccgaactcaagtggcttgtttctaagtctaagggccagaatttcccacagactaccaatacctatagaaacaccgacacggctgagcaccttattatgtggggtattcaccacccctcaagcactcaggagaagaacgacctctatggtacccagtccctttccatctccgttggtagttctacctaccgcaacaattttgttcccgtggtcggtgcaagaccacaggttaacggccagagtgggcgcatcgatttccactggacgttggtccagcctggggataacatcaccttttcccacaacgggggattaatcgcaccctctcgggtctctaagctgatcggacgaggactgggaatccaaagtgacgcaccaatagataataattgcgagagcaaatgcttctggcgcggtgggtcaatcaatacacggctgccgtttcagaatctatcaccaaggactgtgggacagtgccccaaatatgtaaataagcggtccctgatgctcgccactggtatgcggaacgtgcctgagctaatgcaaggaaggggcctgtttggggccattgccggctttctcgaaaacgggtgggagggcatggtggacggatggtacggtttccggcaccagaatgctcaaggcaccggtcaggctgccgattataaaagcacccaagccgctatcgatcagatcactggcaagttaaacaggctggtagaaaaaactaatactgaattcgagtccattgagtccgagttctctgagattgagcatcagatcgggaatgttattaactggacgaaagacagtattacggatatctggacatatcaagccgagctcctggtcgctatggaaaaccaacacactatcgacatggccgacagcgaaatgttgaatctttatgaaagagtgaggaagcagctgcgtcagaacgcagaggaggatgggaaaggatgttttgagatctaccacgcctgtgacgattcctgcatggagagtattagaaacaacacatacgaccacagccagtaccgggaagaggccctattgaacaggcttaatattaatccagtaaccctgtcgagtgggtataaagatattatactgtggttctcctttggcgcttcttgctttgtgctgctcgcggtagttatgggtttggtgtttttttgcctcaagaacggaaatatgcgttgcaccatctgtatc

SEQ ID NO: 856 - DNA, 1683 bp, Influenza A virus
  misc_feature (1)..(1683): Codon Optimized Sequence Encoding H10 Hemagglutinin
atgtataagatcgtggtcatcatcgccctgcttggagctgtaaaaggtctcgacaagatttgtcttggacatcatgctgtggcaaatggcaccattgtaaagaccctgactaatgagcaagaagaagtaaccaacgcaactgagaccgtagagtcaaccggcattaatcggctctgcatgaagggaaggaagcacaaagatctcggcaattgtcacccaataggcatgttgattggaacccctgcttgtgacctgcatctcacggggatgtgggatactttgattgaaagggaaaacgcaattgcgtattgttacccgggagccaccgtgaacgtcgaggccctccgacaaaagatcatggaatcaggagggatcaacaaaataagcactgggtttacctatggaagttcgatcaactcagccgggacaacgcgcgcttgcatgaggaatggcggaaattccttctacgctgaactcaaatggctcgtgtcgaaatcaaagggtcagaacttcccacagactactaatacctacagaaatactgacacagcggagcatttgatcatgtggggcatacaccacccttcttccacacaggagaagaatgacctttacggcacgcagagtctgtccatcagcgtaggaagctcaacctacagaaataatttcgttcccgtggtgggggctcgaccacaggttaacgggcagtccggtcgtattgattttcattggacattggtgcagcccggcgataacattacttttagccacaacggaggcctaattgcccctagcagagtctccaaactgatcgggaggggactggggatacagtcagatgcccctatcgacaacaattgtgagagcaagtgtttctggcgaggcggaagcattaacacccggttaccctttcagaacctatctccaagaactgtgggtcagtgcccaaaatacgtgaacagacggtctctgatgttggctactggtatgcgcaacgttccggaactaattcaaggcagaggactgttcggcgccatcgcagggttcctcgagaacgggtgggaggggatggtcgatgggtggtacggctttaggcatcagaacgctcaggggactggtcaggccgccgattacaaaagcacgcaagctgctatagatcagatcacagggaaactgaatcgcctcgttgagaaaactaacaccgaatttgaatcaatagaatccgaattcagtgaaatcgagcaccagatagggaacgtaatcaactggaccaaagacagtattacagacatctggacataccaggcggaacttttagtcgctatggagaatcagcacacaatagacatggccgacagcgaaatgttgaacctgtacgaacgagtaaggaagcagctgaggcaaaacgcagaagaggacggaaagggctgctttgagatataccacgcatgtgatgatagctgtatggagtcaattcggaacaatacatatgatcactctcaataccgtgaggaagctctgctcaatcgtctgaatattaacccagtgactctttccagtgggtacaaagacatcattctttggttttccttcggagcttcctgctttgtgctgctggcagtcgttatgggattgttctttttctgcctgaagaacgggaacatgcgctgtactatatgtatc

SEQ ID NO: 857 - DNA, 1683 bp, Influenza A virus
  misc_feature (1)..(1683): Codon Optimized Sequence Encoding H10 Hemagglutinin
atgtacaaggtagtggtaataattgctctgctgggagccgtgagaggtctggataaaatctgtttgggtcaccacgccgtcgccaacgggacgatcgtcaaaacactaacaaatgagcaagaagaagtgaccaacgcaacagagacagtggagagtaagagcctgggaaagctttgcatgaagggccgctcatataacgacctgggcaactgtcaccccatcggtattctgattgggactccagcttgcgacttgcatctgaccggcacctgggacacactcatcgagagagaaaacgcagtggcttactgctaccctggcgctaccgtcaatgaagaagccctgcgacagaagattatggagagcggtgggatcagcaaaatctccaccggtttcacctatggaacctccattaacagcgcaggcacaacaaaagcttgcatgaggaatggcggcaactcgttctatgctgaactgaaatggctggtgtccaaaaataagggtcagaatttccctcagactaccaacacttacaggaacacggatacagcagagcacctgattatatgggggattcaccacccttcgtctacccaagagaaaaatgacctgtacggaactcagagcctttcaatatccgtggggtccagtacatatcaaaataattttgtccccgtggttggcgcccgtccacaggttaacggtcagtcagggcggatcgattttcattggaccttacttcagcccggagacaatatcactttttctcacaacggaggactcatcgccccctcccgtgtgtccaagctcataggacggggcctgggtatccagagcgaggcccccatcgataacggctgcgagagcaaatgtttttggaagggagggagtataaacactaagctcccattccaaaatttaagtccacgtactgtgggccagtgtcccaagtatgtgaacaaaagaagcttgatgctggcaactgggatgcggaacgtgcctgagatcatgcacggtcggggcctgtttggcgctatcgcagggtttattgaaaatggctgggagggcatggttgatgggtggtacgggtttaggcatcagaatgcccagggcactggtcaggcggccgattacaagagtactcaggctgccatcgaccagatcaccggcaagctgaaccggttgatcgaaaagacaaacactgaattcgagagtatcgaaagcgaattttctgagatcgagcaccaaatcgggaatataattaattggacaaaggactcgatcactgacatatggacataccaagccgagctgctggtggccatggaaaaccagcataccatagacatggccgattcagaaatgcttaatctttacgagcgtgttaggaagcaactgaggcagaatgccgaagaggacggtaaggggtgctttgagatttatcacgcatgtgacgacagctgtatggagtccattagaaataatacctacgatcacagtcagtatagagaagaggcattgcttaataggctgaacataaatcccgtcaagctgtcttcggggtacaaggacattatcctgtggttcagctttggcgcatcgtgtctgatattactggccgtcgtgatgggattagtgtttttctgcttaaagaacggtaacatgcgctgtactatctgtatc

SEQ ID NO: 858 - DNA, 1683 bp, Influenza A virus
  misc_feature (1)..(1683): Codon Optimized Sequence Encoding H10 Hemagglutinin
atgtacaagatcgtggtcattatcgctctgttaggggcagtaaaaggcctggacaaaatctgccttggccatcatgctgtggctaatggtacaattgtcaaaaccctcacaaatgaacaggaggaggtgacaaacgccacagaaactgtggagagtacagggatcaaccgtctctgcatgaagggaagaaagcataaagaccttggaaactgtcatcccataggcatgctgatcggcactcccgcctgtgacctgcacctgaccggtatgtgggacaccctgatcgaaagggagaatgccattgcctactgttatcctggcgcaacagtgaacgtagaagccttaagacagaagatcatggaatccggaggcataaacaaaattagtactggattcacctacgggagctccattaactctgcaggcaccactcgggcatgcatgcgcaacggcggtaacagcttctatgccgagctgaagtggttagtgtccaagtcgaaaggccagaactttccccagacgacaaacacatatcggaacaccgatactgcagaacacctgatcatgtgggggattcaccaccccagttccacccaggagaagaacgatctgtacggtactcagagcctgtccataagtgttggatcctctacatatcggaataatttcgtgcccgtggtgggcgcaagaccacaggtgaacggccagtctgggagaattgactttcattggactctggtgcaaccaggggacaatattaccttctcacataatggcggcctgatcgcacctagcagggtgtccaagctgataggacgcggactcggaattcagtcggatgcacctatcgataataactgcgagtctaagtgtttttggagaggcggttcaatcaatactaggcttccttttcagaacctgagccccagaacagtggggcaatgccctaaatatgtgaataggcggtctctgatgctggccactgggatgagaaatgtgccagagctgattcagggtagaggcctgttcggcgcaatcgcagggttcctcgaaaacggctgggaaggtatggtggacggatggtacgggttccgacaccaaaacgcccaggggacgggccaggccgccgattacaaatcaactcaagccgcgatagatcagataaccggaaagctgaacagactcgtcgagaagaccaataccgagtttgagtccatcgaaagcgagttctcagagattgagcatcagatagggaacgtaattaactggacgaaagatagcatcacggacatctggacatatcaggcggaactactggtggcaatggaaaatcagcataccatcgacatggccgacagtgagatgttaaatctctatgagcgggtgcggaaacagctgaggcaaaacgctgaagaagacggaaaagggtgctttgagatctaccatgcctgcgacgatagctgcatggagtcaattcggaacaatacttatgaccactcccagtatcgggaggaggccctgctcaatcgactgaacataaacccagtgactctgagttccggatacaaagatattattctttggttcagcttcggagcttcttgttttgtcctcctagcagtggtaatgggcctctttttcttttgcctgaagaacggaaacatgaggtgcacaatttgtatt

SEQ ID NO: 859 - DNA, 1683 bp, Influenza A virus
  misc_feature (1)..(1683): Codon Optimized Sequence Encoding H10 Hemagglutinin
atgtacaaaatagtggtgataatcgcccttctcggcgcagtgaaagggctcgacaagatatgtctgggacatcacgctgtggctaatggcactatcgtgaagacgctcacaaatgaacaggaggaggttacaaatgccactgagacagttgaaagcacaggaatcaatagattgtgtatgaaaggcagaaagcataaggacttggggaactgtcaccctattggcatgcttatcggcacccctgcttgtgatctacatttgacaggcatgtgggacacccttattgagcgcgaaaacgcaatcgcgtactgttatcctggtgctactgtgaacgtagaagctctgaggcagaagataatggaatctggcgggataaataaaatctcaaccggcttcacatacgggagtagcattaatagcgccggtactacccgggcctgtatgaggaatggaggaaactctttttacgcagagctcaagtggctagtatctaagtccaagggacagaattttccccagactactaatacttaccgcaatacggataccgcagaacacttaattatgtggggcatacatcacccatcctctacccaagaaaagaacgacctttacggcacacagtccttgagtatatctgtggggagtagcacctataggaacaatttcgttccggtcgtgggcgctcgcccccaggtgaacggccaatcaggacggatcgacttccactggaccctggtccagcccggcgataacatcacattttcccataacggaggacttatagcaccctcccgggtgtctaaacttattggacgggggctgggaatccagtccgacgcccccatcgataacaactgtgagtctaaatgtttttggcgcggcggatctatcaacaccaggcttcccttccagaatctgtccccccggacagtgggccagtgcccaaagtacgttaacagaaggtctttaatgctcgccaccggcatgcgaaacgtgcctgaactgatccagggaagaggacttttcggagccatcgccggctttttagagaacggatgggaagggatggtagacgggtggtatggattcaggcaccaaaacgctcaggggaccgggcaagcagcagactacaaaagtacacaagccgctatcgaccaaatcacgggtaaactgaaccggcttgtggaaaagacaaacaccgaatttgaatcgatagagagcgaattcagcgagatcgagcaccaaataggaaatgtgatcaactggacaaaggattcgatcacagacatctggacgtaccaagccgagctcctcgtagcaatggagaaccagcataccatcgacatggccgattccgagatgcttaatctttatgaacgggtccgcaaacagctgcgccaaaatgccgaagaagatggtaaaggatgttttgaaatctatcatgcttgtgatgattcctgtatggagtcaatccggaataatacatacgaccacagccagtaccgggaagaagccctgctgaatcgcttaaatatcaaccccgttaccctttcctctggatataaggatattatcctgtggttttcatttggggcatcctgtttcgtccttctggcagtggtcatgggacttttttttttctgtctgaagaacggaaacatgcggtgtacgatctgtata

SEQ ID NO: 860 - DNA, 1683 bp, Influenza A virus
  misc_feature (1)..(1683): Codon Optimized Sequence Encoding H10 Hemagglutinin
atgtataaagtcgtggttatcatcgcccttctgggagccgtcagaggcctggacaagatatgtttggggcatcatgcggtagctaatggaaccactgtcaaaacacttactaatgaacaggaagaggttacgaacgccaccgaaacagtggaatctaccagcctgaataaattatgcatgaagggacgacgctacaaggatctggggaattgccaccccatcggaatgctgattggaacaccagtctgtgacctccaccttacagggacgtgggataccttgattgagcgggagaatgcaacagcttactgttatcccggagtaactattaatgaggaggctctccgtcaaaagataatggagtcaggaggtattagtaaaatgcgcactggctttacatacgggccctctataaacagcgcaggaaccactcgttcatgtatgcgcaatgggggcaactcgttctacgccgagctgaagtggctggtgagtggcaccaaaggtcagaattttccccagactacaaacacctaccggaacacagacactgccgagcatctgatcatctgggggatacatcacccttcctctactcaagaaaagaacgatctgtatggcacacaaagcctgtctatatccgtgggttcttctacctatcaaaacaactttgttccagttataggcgcccggccccaggtgaacgggcagtcaggccgcatcgagtttcactggactctggtccggcccggagataatattacattcagtcataacggcggtttgatcgccccagaccgagtgagcaagctcatcgggaaggggattggcatacaatccggtgctgtgattgacaaggattgcgagagtaagtgcttttggcgaggcggatctattattaccgagctgccatttcagaacctttctcctcgaaccgttgggcagtgccccaaatatgtgaaaaagaggtcactgctcctcgccactggcatgcgaaatgttcctgaggtggtgcagggccgtgggttgttcggtgccatcgcagggttcatcgagaatggatgggaaggtatggtcgacggatggtacggattccgccatcagaatgcacagggtatcggacaggccgccgattataagagcacccagacggctatagaccaaatcaccggcaagcttaaccggctcatagaaaagaccaacacagaatttgagtccatcgagtcagaattcagcgaaattgaacatcagattggcaacgtcatcaattggaccaaggactccatcactgatatctggacataccaggcagaacttttggttgctatggagaaccaacacaccatagatatggccgattccgagatgttgaatctgtacgagagggtccgtaagcagctgaggcagaacgctgaggaggacgggaaggggtgctttgagatctaccacacctgtgacaatagctgcatggagtcgatccggaataacacttatgaccatagtcaatacagagaggaagccctgctcaatcgtttaaatattaatccagtaaagttatcttcagggtacaaggatattattctctggttctcttttggggctagctgttttgtgctcctggccgttataatgggactcgggttcttctgcctaaaaaatggcaacatgcgctgtaccatttgcatt

SEQ ID NO: 861 - DNA, 1683 bp, Influenza A virus
  misc_feature (1)..(1683): Codon Optimized Sequence Encoding H10 Hemagglutinin
atgtacaagattatcgtgatcatcgcactgctgggcgccgttaaagggctggacaaaatatgcttgggacaccacgccgtagctaatggaacaatcgtcaaaaccctgactaatgagcaagaggaggtcacaaatgcaacggaaacagtcgaatccactggcattaataggttgtgcatgaagggccgaaagcacaaagatctcggaaattgtcatcccatcgggatgctgattggcacccctgcctgtgatttgcacttaacagggacttgggacactctgatagagcgtgaaaacgcaattgcatattgctacccaggggcaacggtcaacgtggaggctctccgacagaaaattatggaaagcggagggatcgataagatttcgacaggcttcacgtacggctcctcaatcaactctgccggtacgacgcgcgcgtgtatgcggaatggagggaacagcttttacgcagaactgaagtggctcgtaagcaaaagtaaagggcaaaatttccctcagactacaaatacctaccgcaacacagacacagcggagcacctgattatgtggggaattcaccatccctcaagtacccaggagaagaacgacttatatggcacgcagagtctttccatttctgtggggtctagcacctataggaacaatttcgtcccagttgtcggcgctaggcctcaggtgaatggacaaagcggccgcatagatttccactggaccctggtccagcccggcgataatatcacattttctcacaacggaggactgattgctcctagcagagtatcaaaactgattgggagaggccttggcattcagtctgacgcccccattgacaataattgtgagtctaagtgtttttggcggggaggaagcatcaataccagacttccctttcaaaacctgagtccgcgaactgtcggacagtgccccaaatacgttaataggcgctccctaatgcttgctacaggtatgaggaatgtaccagagttaattcaggggcgcggcctttttggcgccatcgccggcttcctggagaacggctgggagggcatggtggatgggtggtatggcttccgccatcagaacgcacaggggacgggccaggctgcagattataagtcaacccaggctgcaatagaccaaattactgggaagctgaataggctagtggagaagaccaacactgagtttgaatcaattgagagcgaatttagtgagatcgagcaccagatcggtaacgtgattaactggacgaaagattcaattactgacatttggacatatcaggctgagttgctggtggcgatggagaaccagcacaccatagatatggcggatagcgagatgcttaatctgtacgaacgggtgcgcaagcagctccgccagaacgctgaagaagatggcaaggggtgctttgagatttaccacgcttgcgatgattcatgcatggagtccattcggaataatacatacgaccacagtcagtacagggaagaagccctactgaaccggttgaacattaaccctgtgaccctcagttcagggtacaaagacataatactttggttctccttcggggcctcatgtttcgtgctgctggcagtcgttatgggcctattcttcttctgcttgaagaatggaaatatgcgttgcaccatctgcatc

SEQ ID NO: 862 - DNA, 1683 bp, Influenza A virus
  misc_feature (1)..(1683): Codon Optimized Sequence Encoding H10 Hemagglutinin
atgtacaaaatcgtcgtcatcattgcacttctgggagccgtgaaggggctggataagatctgcctcggccatcatgccgtcgtgaacggtaccatagtgaagacattgacgaacgagcaagaggaagtcacgaacgccaccgagacggtggaatccacgggactgaatcgtttgtgcatgaaaggcaggaaccataaggatctgggaaattgccatcccataggcatgcttattggcacgccagcctgtgacctacacttaaccggcacttgggacactttgatcgagcgcgagaatgccatcgcctactgttatccaggagccaccgtaaacgaagaggctctgagacagaagatcatggagagtggcggtataaacaaaatcagcaccggcttcacctacgggagctctatcaactcagccggtactactagagcttgcatgcgcaacggcggaaactccttctacgcagaacttaagtggctcgtcagcaagagcaagggccagaactttcctcagacaaccaacacctaccggaataccgatactgccgagcacttgataatgtggggcatccaccacccttcctctactcaggaaaagaacgatctgtatggtacccagtctctgtccatatcagtgggttcttcaacataccagaacaatttcgtccctgtggtaggagcaaggccccaggtaaatggccagagcggccgcatcgactttcattggactctggtgcagccaggggacaatattaccttcagtcacaacggcggcctgatcgcaccatccagagtgtctaaactgataggccgaggattgggaattcagtcagacgcacccatagataacaattgcgaatcgaagtgtttctggcgcggcggctcaataaacacccgacttccattccaaaacctctctcccagaactgtggggcagtgccccaaatacgtgaataagaggtcgctcatgttagccactggtatgcgaaacgtcccggaactgatgcagggacgaggcctttttggggctatagcaggcttcatcgagaatggatgggaaggcatggttgatgggtggtatggcttccgccatcagaatgctcaggggacagggcaagcggccgattacaaatcaacccaggccgctatagatcaaatcactggcaagctgaatcgcctcatcgaaaaaacaaatacggagttcgagtccattgaaagcgagttttccgagattgaacaccaaattggcaacgtcataaactggactaaggactctattaccgacatatggacttaccaggcagagcttctggtcgctatggagaaccagcacaccatcgatatggccgattccgaaatgttaaacctctacgaaagagtgcgcaagcagctcagacagaacgccgaagaagatggcaaagggtgctttgaaatctaccatgcctgcgacgatagttgtatggagtcgatccgcaataacacttacgatcacagtcaatatcgggaggaggcactgttaaacaggctgaacattaacccggtaaccctctctagtggttacaaagacatcatactttggttttcgtttggggcatcttgttttgtgctcttggccgtagtgatgggacttgttttcttttgtctcaagaacggcaatatgcggtgtactatttgcatc

SEQ ID NO: 863 - DNA, 1683 bp, Influenza A virus
  misc_feature (1)..(1683): Codon Optimized Sequence Encoding H10 Hemagglutinin
atgtataaaatcgtcgtgatcatcgccctgttaggtgcggtcaagggcttggacaagatttgtctgggacatcacgcagtcgccaacggaaccatcgttaaaacgctgactaacgagcaggaaaaagttactaatgccacagagaccgttgagtcaaccggcctcaataggctttgcatgaaaggacggaagcataaagacctgggcaactgccatcctattgggatgttaatcggtacccccgcatgcgacctgcatctgactggaacctgggacaccattattgagcgcgaaaatgccatcgcatattgttaccccggagctactgtgaatgaagaggccctgaggcagaagatcatggagtccggtggaattgacaagatctccactggatttacctacgggagttctatcaatagtgcaggtaccacaagagcctgtatgagaaatgggggcaacagcttttacgccgaattaaaatggctggtgagcaagagtaagggacaaaattttcctcagactacaaacacctacagaaatacagatacggctgagcaccttatcatgtggggcatccaccatccgtcatccacccaagagaagaatgatctttacggaacccagagcttgagcatctccgtgggttcatccacctaccggaacaacttcgtgccagtggtgggggctaggccacaggtgaacggccagtcaggccgcatcgacttccactggacactcgtgcagcctggagataacatcactttctcccacaatggaggactgatagccccatctcgcgttagcaagctgattggccggggtctcggaattcaatctgacgcccccatagacaataactgtgaaagcaagtgcttctggcgtggggggtccattaatacccgtctaccttttcagaatctgtccccccgcaccgtcggacaatgccctaagtacgtgaataaaaggtcccttatgctagctacggggatgcggaatgttccggagctaatccaggggcgcgggctgttcggagccatcgcaggttttctcgagaatggctgggagggaatggtggacggttggtacggattccgccaccagaatgcccaaggcacaggacaggcagctgactacaaatcaacgcaagctgccatcgaccagataacaggaaaactgaacagactcgtcgagaagaccaatacagagttcgaatccatcgagtctgaatttagcgaaatcgagcaccagatcggaaacgttatcaactggacaaaagactccatcaccgatatctggacttaccaggctgaacttcttgttgccatggagaatcagcatactattgatatggccgactcagagatgctcaacctctatgaacgggtccggaaacaattacgacagaacgcggaggaggacggcaaaggttgctttgagatatatcacgcgtgcgacgattcgtgcatggaatctatccgcaataatacttacgaccactctcagtaccgggaggaagcactcctgaatcggttgaacatcaaccccgtgacactttcttccggctataaggatataatcctgtggttttcctttggagcatcctgttttgtactcctcgccgtagtgatggggctggtctttttctgccttaagaacgggaacatgaggtgtactatatgtatt

SEQ ID NO: 864 - DNA, 1683 bp, Influenza A virus
  misc_feature (1)..(1683): Codon Optimized Sequence Encoding H10 Hemagglutinin
atgtacaaggtggtggtcataatcgccttgctaggcgccgtgagagggctcgacaaaatttgcttggggcatcatgcagtcgctaatggaaccatcgtgaaaacactcaccaacgagcaagaagaggttactaacgccaccgagaccgtagagagtaaatccctggggaagctgtgtatgaagggccggtcttataatgatctgggcaattgccatcccatcggaattctgatcgggacccctgcatgtgatctgcatctaactgggacgtgggatactctgatcgagcgcgagaacgcagttgcttactgttatccgggcgccaccgtgaacgaggaggcactccgacagaaaattatggaatcgggtggaattagcaagatatctactgggttcacctatggcactagcatcaactccgctgggacaaccaaagcgtgtatgagaaacggggggaattctttctacgccgaactgaaatggctggtgtccaaaaataaagggcagaattttcctcagaccaccaacacataccggaacaccgacaccgccgagcacctgatcatctggggcattcatcacccgagctcgactcaagagaagaacgatctctacgggactcagtcgctgagtatcagcgtgggaagcagtacttaccagaacaattttgtacccgtggtgggagcccggcctcaagtcaacggccagtccggcaggattgacttccactggaccttactgcagccaggggacaacatcaccttttcacacaatggtggactcatcgcaccctccagagttagcaaactgattggaagagggcttggtattcagtcggaagcccctattgataatggttgtgagagtaagtgcttctggaaaggaggcagcataaataccaaactccccttccagaacctctctcccagaaccgtcggccagtgccctaagtacgtgaataaacgctcgttgatgctcgcgacaggaatgaggaacgtgcctgaaattatgcatggtcgcggactgttcggagctatcgccgggttcatcgagaatggctgggaagggatggtggacggttggtacgggtttcgacaccagaacgcacagggcactggccaggcagcagattataagtccactcaggccgcaatcgaccagattaccggcaaattaaatagattgatcgagaaaacgaatactgagttcgagagcatcgaatcggagttctctgaaatcgagcatcagattggaaacattataaattggaccaaggacagcattacagatatttggacgtatcaggcagagctgctggtggccatggaaaaccagcatacgatcgacatggccgattccgaaatgctcaacctgtatgaaagggtgaggaaacagctgagacaaaacgcagaagaagacggcaaaggttgcttcgaaatttaccacgcttgcgacgattcatgcatggagagcattcggaataatacctatgatcatagccagtacagagaggaggccctgctaaatagactgaatataaatcccgtaaaactgagctctggctataaggacattattctgtggtttagtttcggagcatcctgcctcatcctcctggcagtggtcatgggcctcgtgttcttttgtctgaagaacggaaatatgcgatgtactatttgtatc

SEQ ID NO: 865 - DNA, 1683 bp, Influenza A virus
  misc_feature (1)..(1683): Codon Optimized Sequence Encoding H10 Hemagglutinin
atgtacaaaatagtcgtgatcatcgcactgctgggggccgtgaaaggtctcgataagatttgccttggacaccatgccgtggctaacgggactattgtgaagacacttaccaatgagcaggaggaagttaccaacgctacagaaactgtcgagtcgactggtattaataggctgtgtatgaagggacgtaagcataaagacctcgggaattgccaccctataggcatgctgataggcaccccagcatgtgacctgcacctcacaggcatgtgggacacattaatcgaaagggagaatgccatagcctattgctacccaggtgcaacagttaatgttgaagcattgcggcagaaaatcatggagtccggcggcattaacaagatctctacgggatttacgtacggctcaagcattaatagtgccgggactactcgagcatgcatgaggaatggagggaacagtttctacgccgagctgaagtggctcgtgtctaaaagtaaagggcagaacttccctcagaccactaatacctacagaaacacagacaccgcagaacacttaataatgtggggcatacatcaccccagcagcactcaggagaaaaacgacctgtacggtacccagtccctgtccatttccgtgggaagttctacgtatcggaataacttcgtcccggtggtgggagccaggccgcaggttaacggacaaagcgggcgaattgatttccactggacactggtgcagcctggcgacaatataactttctcccataatggcggactgatcgctccatcccgggtcagcaagctaatcggtagagggctggggatccaatcagacgcacctattgataacaactgcgagagtaagtgcttctggcgaggcggtagcataaacacacgtttgccatttcagaatcttagtcctcgtactgtgggccaatgtccaaagtatgtcaacaggcgcagtttaatgttagctactggaatgcgcaacgtacctgagctcattcaaggtcgaggcctgttcggagccattgctgggttccttgagaatgggtgggagggcatggtcgacggatggtacggattccgccaccagaacgcccagggcacaggccaggcagccgattataaaagtacccaggctgccatcgaccagatcactgggaaactcaaccgtctggtcgaaaagactaacaccgaatttgagtctattgaatcagaattcagcgaaattgagcaccagatcggcaatgtgatcaattggacgaaagactctattaccgacatttggacctaccaggccgagttactggtggccatggagaaccagcacaccatcgacatggccgatagtgaaatgcttaacctctacgaaagagtccgaaaacaactccgccagaacgcggaggaggatggaaagggctgcttcgaaatctatcatgcctgcgacgactcctgtatggaaagcattcgcaacaacacctacgaccacagtcagtacagggaggaggcgctgcttaataggctgaacatcaatccggtaacactgtcatcgggatacaaggacatcatactctggttctcattcggcgcgtcctgtttcgtactgctcgcagtcgtaatggggctcttcttcttctgcttaaagaacggcaacatgcgctgcactatctgcatt

SEQ ID NO: 866 - DNA, 1683 bp, Influenza A virus
  misc_feature (1)..(1683): Codon Optimized Sequence Encoding H10 Hemagglutinin
atgtataaaattgtggtcataattgcactgctcggcgcagtcaagggtctggataagatttgccttggtcaccatgccgtagccaacggaaccattgtgaagacccttacaaatgaacaagaagaagtgactaatgcaactgagaccgtggaatctacaggtatcaatcgcctgtgtatgaaggggcgaaaacataaagatctcggcaattgtcaccccattgggatgctgattggcaccccggcatgtgacctacatttgaccggaatgtgggatacactaatcgaacgggagaatgctattgcgtactgttaccctggcgctaccgtcaatgtggaggccctgcgccaaaaaatcatggaatctgggggaatcaataagatctccactggcttcacttatggatccagcattaacagcgctggcacaactcgcgcctgtatgcgcaatgggggcaattccttctatgcagagcttaagtggttagtgagcaagtcgaaaggccaaaacttccctcaaacaaccaatacatataggaacaccgataccgctgaacatctcattatgtggggaatacatcatcccagctccacacaagagaagaatgatttgtacgggacccaatccttgtctattagcgtaggctcctccacataccggaacaacttcgtcccagtcgtgggggcacggcctcaggttaacggacagtccggccgtattgacttccactggactctggtgcaaccaggggacaacatcactttctctcataacgggggtctgatcgcacctagtagggtgtccaaacttataggaaggggtctcggcatccaaagcgacgcccccatcgataataattgcgaaagcaagtgtttttggaggggagggagcatcaatactcggttaccatttcagaatttaagtccaagaacagtaggacaatgccctaagtatgttaatagacgttccctcatgttagcaactggaatgaggaacgttccggagctgattcagggaagaggactcttcggggcaatcgccggttttttggagaacggatgggagggcatggtggatggttggtacggattccgccatcagaacgcccagggcaccgggcaagctgcagactataaatcaacacaagcagcaattgatcaaatcaccggcaagttgaacaggctggtcgagaaaaccaacactgaattcgagtccatcgagagcgagttctctgaaatagagcatcagattggaaacgttatcaactggaccaaggatagtatcacggacatttggacttatcaagccgagctgctggtcgccatggagaatcaacatactatcgacatggcggatagtgaaatgctcaacctgtacgagcgcgtgcgcaagcaactgcgccagaacgctgaagaggacggtaaaggttgctttgaaatttatcacgcttgtgatgactcctgcatggagtcgatccgcaataatacgtacgatcacagccagtaccgggaggaggctttgctgaaccggctgaacatcaaccctgtaaccttgtcttctggctacaaggatattatactctggttcagcttcggcgccagctgcttcgtcctgctggccgtggttatgggactcttctttttctgtctgaaaaatggtaatatgcggtgcacaatttgtatc

SEQ ID NO: 867 - DNA, 1683 bp, Influenza A virus
  misc_feature (1)..(1683): Codon Optimized Sequence Encoding H10 Hemagglutinin
atgtacaagattgtggtaatcatcgctttacttggggcagtgaaaggattggacaagatttgtttggggcaccatgcagtggccaacggcaccattgttaaaacactgacaaatgagcaggaagaggttaccaatgcaacggaaaccgtggaatctactggaatcaacagactgtgcatgaagggccgcaagcataaagacttggggaattgccacccaattggaatgcttattggaacaccagcttgcgatttacatctgactggcatgtgggacaccctcatcgagcgggaaaatgctatcgcttattgctacccgggggccacagtgaatgtggaagcactacggcaaaaaatcatggaatcaggcggaatcaacaaaatctcaaccggcttcacctatgggtcatccatcaatagtgctggcaccacacgcgcctgcatgcgaaatggtggaaactcattctatgcggaactgaaatggctagtgtcaaaaagcaaagggcagaattttccacagactacgaacacttatagaaatactgacacagctgagcatcttattatgtggggcatccatcatccaagcagtacacaggaaaagaatgacctatacggtacacagtccctgtctatttccgtgggatcctccacatacagaaacaactttgtccctgtggtgggagcaaggcctcaggtcaacggacagtctggccgcatcgatttccattggaccctggttcaaccgggcgataacatcaccttcagccacaatggaggcctgatcgcccctagcagggtgtcaaagcttataggcaggggtcttgggatccaatccgacgcccccatagacaataactgcgagtcgaaatgtttctggcggggtggttccattaatactcgtctccccttccagaatctttctcccagaactgttgggcaatgccccaagtacgtaaatcgtagaagtcttatgctcgcaaccggtatgcgcaacgtgcctgagctcattcagggccggggcctctttggggctattgccggcttccttgaaaacggctgggagggtatggtggatggctggtacggattccgccaccagaatgcccaaggcacaggtcaggctgccgactataagtcaacgcaggctgccatcgatcagatcacaggcaagttgaacaggctagtggagaagaccaacacagagtttgagagtattgagagcgagttttccgaaatcgaacaccagataggcaacgttatcaactggacaaaggacagtattacagacatttggacatatcaggctgaactgttggtggccatggagaaccagcacactatcgatatggcagactccgagatgctgaatttgtacgaaagggtccggaagcagctccgccagaacgccgaagaggatgggaaaggctgctttgaaatttaccacgcttgcgacgactcctgtatggaatccattcgaaataatacatatgatcacagccagtaccgggaagaagctttacttaatcgattgaatatcaatccagttaccctttcctccggctacaaggacatcattctgtggttctccttcggtgcctcgtgcttcgtcctgcttgcagttgttatggggctgttttttttctgtctgaagaacgggaatatgcggtgcactatttgcatc

SEQ ID NO: 868 - DNA, 1683 bp, Influenza A virus
  misc_feature (1)..(1683): Codon Optimized Sequence Encoding H10 Hemagglutinin
atgtataaaatcgtggttatcatcgccctgttgggcgcagtcaaaggcttagacaaaatttgcctgggccaccatgccgtggccaatggcacaattgtaaaaactttgactaatgagcaggaggaagtcactaacgccacggaaaccgtggagtccactggaatcaaccgcctgtgcatgaagggacggaagcataaggacctcggtaattgtcatccgataggtatgctcatcggcacccccgcttgcgacttacatttgacaggaatgtgggacactctgattgagagggagaacgccattgcctactgttaccccggcgcaacagtcaatgtggaggcgctgcgtcaaaagataatggagagtggaggcatcaacaaaatttcaacagggttcacatacgggagctcaattaactctgcgggcacgaccagggcttgcatgagaaacggcggtaattccttttatgcggagttgaaatggctggtctccaagtccaagggtcagaatttcccacaaaccacaaatacttaccgaaatacggacactgccgagcatctgataatgtggggaatacaccatcctagttctacgcaagagaaaaatgacctctatgggacgcaatccttgagtatcagcgttggctcctcaacctaccggaacaacttcgtcccagttgtaggagctcgacctcaggtgaatggacagtcaggtcgtatcgattttcattggaccctcgtgcaacctggggacaacataaccttctcccacaacggcgggctgatagcacccagtcgtgtctccaaattgatcgggagggggctgggcatccaatcagatgcaccaattgataataattgtgagagcaagtgcttctggcgtgggggtagcatcaacactcgcctcccctttcagaacttgtcaccccggaccgtcggtcagtgtcccaagtatgttaatcggcgttcattaatgctggcaaccggtatgcgcaacgtccccgagctaatccaaggaagagggctttttggggctatagcaggatttttagagaacggttgggagggcatggtggacggatggtacggctttcggcaccagaatgcgcaggggacagggcaagctgccgattataagtccactcaagctgctattgatcagattacaggcaagcttaatcgcctggtcgagaagactaacacagagttcgagagcattgagtcagaattctctgaaattgagcaccaaatcgggaatgtaataaattggacaaaggacagtattaccgacatctggacttatcaagccgagctcctggttgctatggagaatcagcacacaatcgacatggccgatagcgagatgctaaacctgtacgaaagggtgcgcaagcagctgaggcaaaacgctgaggaagatggcaagggctgtttcgagatttatcacgcgtgtgatgattcatgcatggaatcaattaggaacaacacttacgatcattctcagtaccgggaggaggcactcctgaacaggctcaacataaaccctgtcaccctgtcttcaggctataaggacattatactatggttttcttttggcgcctcctgttttgtgctcctcgccgttgtaatgggccttttttttttttgcctgaagaacggtaatatgcggtgtactatttgcatt

SEQ ID NO: 869 - DNA, 1683 bp, Influenza A virus
  misc_feature (1)..(1683): Codon Optimized Sequence Encoding H10 Hemagglutinin
atgtacaagattgtagtgattatcgcactgctaggcgcggtgaagggtctcgacaagatttgcctgggccatcacgcggtggccaacgggactatcgtgaagactctgaccaatgaacaagaggaagttactaacgccaccgaaactgtggagtccacaggcatcaatcgcttgtgtatgaagggaaggaagcataaagacctgggtaattgtcaccccatagggatgcttatcggtacaccagcttgtgatctgcatttaacggggatgtgggacacacttatagaacgtgagaatgccattgcctattgttaccccggagctaccgtaaacgtggaggccctgcgccagaagatcatggagtcagggggcatcaataagatcagtaccggctttacctatggtagctctatcaactccgccggcactaccagggcctgtatgaggaatgggggaaacagcttctatgctgagctgaagtggctagttagcaagagcaagggccagaacttccctcaaactacaaatacgtatcggaacaccgacacagcggagcacctgataatgtggggaatccaccacccatcgtccacccaagaaaagaacgatctgtacggtactcagtccctgagtatttccgtgggctccagtacgtaccgaaataatttcgtcccagtggtcggggcaaggccgcaagtgaatggccagtcaggacggatagactttcattggacactggtgcaacccggcgataacatcaccttcagccataacggggggctgatcgccccgagccgagttagcaaacttatcggccggggcctgggcatccagagtgatgcacccatcgacaataattgcgagagcaaatgtttttggaggggtggatcgataaacacacgcctcccgttccaaaatctcagtcctagaacagtggggcagtgtcctaagtatgtgaatcgccggagccttatgttggccactgggatgcgaaatgtgcccgaactaattcaagggcgaggactgttcggcgccattgccggcttcctggagaatggctgggaaggcatggttgatggttggtatggctttcgccatcagaatgcacaggggacaggccaggccgcggattacaaatcgacccaagctgcaattgatcagatcacagggaaactgaatcgacttgtggagaaaactaataccgaatttgaatctatcgagtccgaatttagcgaaatcgagcaccagatcggtaacgtgatcaattggactaaggactccattacagacatatggacatatcaggccgagttgttggtggcaatggagaaccagcatactatcgacatggccgattctgagatgctaaatctgtatgaacgcgtccggaaacagctcagacagaatgctgaggaagatgggaagggatgcttcgaaatataccacgcctgcgacgacagctgtatggagtcaattcgcaacaacacttacgatcactcccaataccgggaggaggcccttcttaacagactcaacattaatcctgtgactctgtcatccggatacaaagacataatactctggtttagctttggcgcaagttgttttgtgctgctcgcagtggtgatggggttgttttttttctgcctgaaaaatggtaatatgcgatgcactatctgcatc

SEQ ID NO: 870 - DNA, 1683 bp, Influenza A virus
  misc_feature (1)..(1683): Codon Optimized Sequence Encoding H10 Hemagglutinin
atgtacaaaattgtggtgataattgcattgctcggagcagtcaaagggctggacaaaatatgtttggggcaccacgccgtggttaatggtaccatcgttaagactctgaccaacgaacaggaagaggtgaccaatgctaccgagaccgtggaaagcactgggttgaacaggctgtgcatgaaaggaaggaatcacaaggacctgggaaactgtcatccaatcggaatgctcattgggactcccgcatgtgatctgcatctgacgggcacctgggataccttgatagagagggagaacgccatagcatactgttatcccggagccaccgtgaacgaggaggcactgaggcagaaaattatggaatctggagggatcaataaaattagcacagggtttacctatggctcaagtatcaatagcgccgggactacacgggcctgcatgcgaaatggagggaactccttctacgctgaactaaagtggctggtcagtaagtccaaagggcagaatttcccgcagacaaccaacacttaccgcaataccgatacggctgaacacttaatcatgtggggcatccatcatccctctagcacacaagagaaaaacgacctgtatggaacacaaagcctcagcatctccgtgggttcatctacatatcagaacaacttcgtgcccgtcgttggcgcccgacctcaggtgaatggtcaatcgggccggattgactttcactggaccctcgtccagccaggtgataacatcaccttcagccacaacggcggactcatcgccccatctcgtgtgtccaagctcattggcagagggcttggcatccagtctgatgcacccatcgataacaattgcgagagcaagtgtttctggcgcggtggatcaataaatacgcggctcccctttcagaatctttctcccagaaccgtaggccagtgtccaaagtatgtaaacaaaagatcattgatgctggccacaggaatgaggaatgtgcctgagctgatgcagggcagaggcctgttcggtgcgatcgccggcttcatcgaaaatggctgggaggggatggtggacggatggtatggcttccgccaccagaacgctcaggggaccggacaagctgcggattataagagcactcaggcggcaatcgaccagatcaccggaaaactcaaccgtctcatcgagaagacaaacaccgaatttgagtctatagaatctgagttcagtgaaatcgaacaccaaatcggcaacgtcataaattggactaaggactccatcaccgatatctggacctatcaagccgagctgctggttgccatggagaatcagcacacgatcgacatggctgattctgaaatgctgaacctctatgaaagagttcggaaacagctcagacaaaacgccgaagaggacggcaaaggatgttttgagatctatcatgcctgcgatgatagttgtatggagagcatcaggaataatacatacgaccactcccagtatcgcgaggaagcactgctcaatcggttaaatataaatccagtgacgcttagtagtgggtataaggacataatcctctggttctctttcggcgccagctgtttcgttctgctggccgtggtcatgggacttgtgttcttttgtcttaaaaatgggaacatgagatgcacaatatgtatt

SEQ ID NO: 871 - DNA, 1683 bp, Influenza A virus
  misc_feature (1)..(1683): Codon Optimized Sequence Encoding H10 Hemagglutinin
atgtataaaatagtggtgataatcgcgctactgggcgcagtgaaggggctcgataagatttgcttgggtcatcatgctgttgcaaacggcaccatcgttaaaacactgaccaacgagcaggaggaggtaacgaacgccacggagacggtggagtctaccgggatcaaccgtctgtgtatgaagggtcgcaagcataaggatttaggaaattgtcatcctatcggaatgcttataggtaccccggcctgcgatctccatctgacaggcatgtgggatactctcatcgaaagagagaatgccatcgcgtattgttaccctggggccacagtaaatgtcgaagcattgagacagaaaatcatggagtccggaggcattaataagatttccaccggcttcacctacggatcttccatcaattccgcaggcacaaccagagcctgcatgcggaatggagggaattccttttacgccgaattgaaatggcttgtgtcaaagtcaaagggacagaactttccccaaactacgaacacatatagaaatacagataccgcagaacacttaattatgtggggcatccaccacccgtcaagtactcaggagaagaatgacctttacggcacccagtctctttcaatctcagtcgggagctccacatatagaaacaactttgtacctgtggtcggtgcaggaccgcaggtgaatggccaatcaggaaggatcgattttcactggacactggtccagcctggtgacaacatcacgttctcacacaatgggggcctaatagccccctcccgcgtgagcaagctaattggccgcggattgggtatccagagcgacgcccctatagacaataactgtgagagcaagtgcttctggcgcggagggtcaattaacacccggctccccttccagaacctgtccccccggacggtgggccagtgcccaaaatacgtcaatcggcgctccctgatgttggccacaggcatgcggaatgttcctgaactgatacagggtcgggggttgttcggagcaattgccgggtttcttgaaaacggctgggaaggtatggtggatggttggtacgggttcaggcaccagaacgctcagggtaccggccaggcggctgactacaaatcaacccaggcagcaatcgaccagattacaggaaagctgaatcgccttgtggagaaaaccaataccgaatttgagtccatcgagtctgagttcagcgagatagagcatcagattggcaacgtcatcaactggacgaaggactccattactgatatatggacttatcaggctgaactgctggtagccatggagaaccagcacacaattgacatggctgactccgagatgctgaatctatacgagcgcgtgaggaagcagctcagacagaacgctgaggaggacggtaagggttgcttcgagatttaccacgcctgtgatgactcctgtatggagtcaatcaggaacaatacctatgaccactctcaatatcgggaggaagcgcttctcaaccgtcttaacattaatcccgtgacactgtcttcaggttacaaggatatcatcctgtggttcagctttggcgccagctgtttcgtgctactagcagtggtgatgggcctgttttttttctgcctgaaaaatgggaacatgaggtgcacgatttgcatc

SEQ ID NO: 872 - DNA, 1683 bp, Influenza A virus
  misc_feature (1)..(1683): Codon Optimized Sequence Encoding H10 Hemagglutinin
atgtataaaatcgttgtaattattgcactgcttggcgccgtgaagggactcgacaagatctgcctgggccaccacgctgtagccaacggcaccattgtgaagaccctgacaaatgagcaggaggaggttaccaatgccactgagaccgtggaatccacaggcattaaccgcctgtgtatgaagggaaggaagcacaaggaccttggcaattgtcacccaatcggcatgctcatcggcacaccagcatgcgacttgcacctgaccggaatgtgggacacgctcatagaaagagagaatgccattgcctattgctacccaggagccaccgttaacgtggaggcactgaggcagaagatcatggagagcggaggcatcaataaaattagtacggggtttacatatggctcctctataaattccgccggcaccacccgggcctgcatgcggaatggcggaaatagtttctacgctgagttgaaatggctggtgagcaagagtaaggggcagaactttccgcaaactaccaatacgtataggaacactgacaccgccgagcacctaatcatgtggggcatacatcatcccagctccacgcaggagaagaacgacctgtatggaactcaaagcctatctatctccgtgggatccagtacataccggaataactttgtgccagtagtgggcgccagaccgcaggtgaacgggcaatccggcaggatcgacttccactggacactggtgcaaccaggcgacaacattactttcagccacaatggtggtttaatagccccctcaagggtttccaaattgattgggcgggggcttggtattcaatctgacgctccaatagataacaattgtgaaagtaagtgtttctggcgcggcggctctattaatactcgccttccattccaaaatctctcaccacgtaccgttggccaatgtcccaaatatgtgaaccgtaggtccttgatgctcgcaacgggaatgaggaacgttccggagctgatccagggccgaggactctttggtgctattgccggatttctggagaacgggtgggagggcatggtggatggatggtacggcttccgacatcagaatgcacaaggcaccgggcaggccgccgattacaagtccacgcaagctgccattgaccagattacggggaagttgaaccggctcgtcgagaagaccaatactgaattcgaatccattgagagcgaattttctgaaattgaacatcagattggtaacgtcatcaattggactaaggactcaataacagacatctggacttatcaggctgaactcctcgtcgcgatggaaaatcagcacaccatcgatatggccgactctgagatgctgaacttgtacgagcgggtgagaaaacagcttcgacagaatgccgaggaagatggcaagggctgcttcgagatctatcacgcttgcgatgactcatgcatggagtctatccggaacaacacttatgaccactcccaataccgcgaggaggccctgctgaataggctgaacatcaacccagtgaccttgagctcaggctataaggacataatcctgtggtttagctttggggcctcgtgctttgtcctgctggccgtagttatggggcttttcttcttttgtcttaagaatgggaatatgaggtgtacaatctgtatc

SEQ ID NO: 873 - DNA, 1683 bp, Influenza A virus
  misc_feature (1)..(1683): Codon Optimized Sequence Encoding H10 Hemagglutinin
atgtacaagatcgtggttatcatcgcactcctcggggctgtgaagggtctcgacaaaatctgccttggtcatcacgcagttgccaacggaactattgttaagaccttgactaatgagcaggaggaggtgacaaacgccacagaaaccgtggaaagtacggggatcaaccgtttatgcatgaagggaaggaaacacaaagatctcggtaactgccatccgatcggtatgctcattggcactccagcttgcgacttgcacttgaccggtatgtgggacacattaattgaacgcgagaacgccatcgcctattgctaccccggagccactgtgaacgtggaagcactccgacagaaaataatggaaagtggggggataaataagatctcaaccggatttacatacggttcctcaattaatagcgccgggaccactagagcatgcatgcgaaatggaggtaattctttttacgctgagcttaaatggctggtgtctaaaagcaagggccagaattttccacagacgacgaacacttataggaatacagacacagccgaacacctgatcatgtggggaatccaccacccatctagcacacaggagaaaaacgacctatatggtacccaaagcctgtcaattagcgtcggcagtagtacataccgcaataatttcgttcccgttgtcggagccaggccgcaagtgaacgggcaaagtggcagaattgatttccactggacactggtccagcccggggataacattacattcagccacaacggcgggcttatcgccccctcccgtgtgagtaagctgatcggccggggcttaggtatccagtccgatgctcccatcgacaacaattgtgaatcgaagtgcttttggcggggcggctccatcaatacccggctgcctttccagaacctgagccccaggaccgttggacagtgtcccaaatacgttaaccggcggagtctgatgcttgcaaccgggatgcgcaatgtgcccgaactgatccaggggcgaggactgttcggggccatcgccggattcctggagaatggctgggagggtatggtggacggctggtacggctttaggcaccaaaatgctcaaggaacagggcaggctgctgactacaaatcaacccaggccgctattgatcaaattactggaaagctgaatagattggtggagaaaactaatactgaattcgagtccatcgaaagtgagttcagcgagatcgagcaccagattggtaacgttattaactggaccaaagacagcatcaccgacatttggacctaccaggccgagcttctagtagccatggaaaatcaacacacgatcgatatggctgattcagagatgctgaatctgtatgagcgggtccggaaacagctgagacagaatgcagaggaagacggtaaggggtgttttgagatttaccatgcctgcgatgattcttgcatggaatctatcaggaacaacacctatgaccactcccaatatcgcgaggaggccctgctgaacaggttaaacatcaaccccgtcaccctgtcttcaggatataaagacatcatcttatggttctccttcggagcgtcctgttttgtgctgttggcagtggtcatggggcttttctttttctgtctaaaaaacggtaacatgcggtgcaccatatgcatc

SEQ ID NO: 874 - DNA, 1683 bp, Influenza A virus
  misc_feature (1)..(1683): Codon Optimized Sequence Encoding H10 Hemagglutinin
atgtataaaattgtagttattatcgccctgttgggcgctgtgaagggcttggacaagatctgcctgggacaccatgcagtcgcaaatggaacaattgtcaagacactgactaatgagcaggaagaggttaccaacgccacagagaccgtagagtccaccgggattaatcggctatgcatgaaaggaagaaagcacaaagatctcgggaactgtcatccaattggtatgctgatcggaacccccgcctgtgatctccatcttactggcacttgggacaccttgattgagagggaaaacgccattgcttattgttacccaggagctaccgccaacgtcgaggccctaaggcagaagatcatggagtctggaggaattgataagatctcaacggggtttacatacgggtctagtatcaatagcgcaggcactacccgcgcttgtatgaggaacggcggcaactcgttttacgccgagttgaaatggctggtcagtaaatcaaaggggcagaattttccacagaccacaaacacttataggaataccgatacagctgaacacctcatcatgtggggcatccatcaccccagctccattcaagagaagaacgacttgtatggcacacagtcattgagcatcagtgtgggcagcagcacatacagaaacaacttcgtgcccgtggttggggcaagacctcaggtaaacggccagtccggtaggattgacttccattggacgctcgtgcaaccgggagataacatcaccttcagccacaatgggggactcatcgcaccctctcgagttagcaaactgatcgggcgaggcttaggcatacaatccgacgcgcctatcgataacaattgcgaatccaaatgtttctggcgcggcggtagcattaatactcgtctgccattccagaaccttagccccaggacagtgggacagtgtccaaaatacgtgaatcgcagaagtctcatgctggctaccggcatgaggaacgtgccagagcttatacaggggcggggcttgttcggagcgatcgctggcttcttggagaatggctgggagggcatggtcgacggatggtatggttttcgacatcaaaacgcccagggcacggggcaggccgccgattacaagtccactcaggcagcaatcgaccagatcaccggtaagcttaatagactggtcgagaagacaaataccgagttcgaatctattgaatccgagttcagcgaaatcgaacaccaaatagggaacgtcatcaactggaccatggacagcatcaccgatatatggacatatcaggctgagttgcttgtggccatggaaaatcagcacacaatcgatatggctgattccgaaatgctgaacctgtacgaacgggtaaggaagcagctgcggcagaacgcagaagaggatgggaagggctgcttcgaaatttaccacgcttgtgatgactcttgtatggagtctattcgcaacaacacctacgaccattctcagtatcgtgaggaggcccttctcaatcgtctgaacatcaatccggtgaccctatcttcaggatataaggatattatactctggttctccttcggggcaagctgcttcgtcttgctggccgtcgtcatggggctggttttcttctgtttaaaaaatggaaatatgaggtgcaccatttgtatc

SEQ ID NO: 875 - DNA, 1683 bp, Influenza A virus
  misc_feature (1)..(1683): Codon Optimized Sequence Encoding H10 Hemagglutinin
atgtacaagattgtagttattatcgctttactgggagcggtcaaaggtctggacaagatatgccttggacaccacgcagtggctaacggcacaatcgtcaaaactctgacaaacgagcaggaggaggtcactaatgcgaccgaaacggtggagagcaccggaattaatcgactatgtatgaagggcaggaagcacaaggatctcgggaactgccatcccatcggcatgctgataggcacgccagcctgcgatcttcatctgaccggaatgtgggataccctgatcgagagagaaaacgccattgcatactgttacccgggagcaaccgtcaatgtggaggcgctgagacagaaaattatggaaagcggagggatcaataaaatcagtaccgggtttacttatggctcatcaatcaattcagcaggcactactagagcttgcatgaggaatggagggaatagtttctacgcggagttgaaatggctcgtgagtaaatctaaggggcagaattttccccagactacaaatacgtatagaaacaccgatactgccgagcacttaatcatgtggggcatccatcatccaagcagtacccaggagaaaaacgacctctatgggactcagtccttgagcattagcgtcggatcttccacatacagaaacaatttcgttccagtcgtcggagctcgacctcaggttaacgggcaatccgggcgaatagactttcattggactctggtgcagcccggggacaacataaccttcagtcacaatggagggctgatagcccccagtcgcgtgagtaaattgattggcaggggcctaggaatccaatctgacgcacccatcgacaacaactgcgagagcaaatgcttttggcgcggtgggtcaataaacactcgcctcccttttcagaatttgtcacctcggacagtgggacagtgccctaagtatgtgaatcgccgatccctgatgctagccaccggcatgcgcaatgtgcccgagctgattcagggaaggggcctgttcggcgccatcgccggcttcttggaaaatggctgggaggggatggttgacggctggtatggcttccggcatcagaacgcacagggcaccggccaggcggccgactataagtccacacaagcagccatcgatcaaatcacgggaaagctcaataggctggtcgagaaaacaaacacagaattcgaaagtatcgaatcagagttctccgagatagagcaccagatcggaaatgtgatcaattggacaaaggacagcatcactgacatatggacgtaccaggcagagctgcttgtcgccatggagaaccagcatacgattgatatggcagactctgaaatgctgaacctctacgagagagtacggaagcaactacgtcagaatgcagaggaggatgggaaaggatgctttgaaatctatcatgcatgtgacgattcttgcatggagtcaatacgcaacaatacgtacgaccacagccagtatcgggaggaagcgctgcttaacagactgaatataaatccggtgacactgtcatctggctacaaggacatcatcttatggttttcgtttggtgcgagttgttttgtcttactagccgtcgttatgggtttattctttttttgtttgaagaatgggaacatgaggtgtacaatttgcatt

SEQ ID NO: 876 - DNA, 1683 bp, Influenza A virus
  misc_feature (1)..(1683): Codon Optimized Sequence Encoding H10 Hemagglutinin
atgtacaagatcgtggtcataatcgcccttctcggtgctgttaagggactagataagatatgcctgggccaccatgccgtagctaacggtacaatagtgaagacattaactaatgagcaagaagaggtgacgaacgctactgagactgttgagagcacaggcattaaccggctgtgtatgaagggccgcaagcacaaggatctgggaaattgccacccaattggcatgctgatcggaacaccagcgtgcgatttgcacctaaccggtatgtgggatactctgattgagcgtgaaaatgctattgcctactgttatcccggcgctacagtcaacgtggaagcgctgcgccagaagatcatggaatctggaggaattaataagatctcaactggtttcacctacggtagctcgattaacagcgcaggaacaactcgtgcctgcatgagaaatggaggcaatagcttttatgctgaactgaaatggctcgtgtctaagtcaaagggccagaatttccctcaaacaactaacacctacaggaatactgacactgcggaacatctgatcatgtggggcattcaccacccctcttcaacacaggagaaaaacgatctctacggcactcagtcgctgtccatctctgtggggagctctacctatcgtaacaatttcgtcccggttgttggcgcccggccacaagtgaacgggcagagcggccggatcgacttccactggaccctcgtacagcctggggacaacatcaccttctcacacaacggagggctaatcgccccctcaagggtcagcaagttgataggcaggggcttgggaattcagtcggatgccccaattgataacaactgcgagagcaaatgcttttggcgcggaggatccatcaatacaaggctccccttccaaaacctcagccccagaaccgttgggcagtgtcctaaatatgtgaacaggagatctctgatgctggccactggaatgagaaatgtgcctgagctgatccagggccgaggactgtttggagcgatcgccggatttcttgaaaacggctgggaaggcatggtggatggctggtacggatttagacatcagaatgcccaagggaccggccaagctgcagactacaaaagtacccaggccgcgatagatcagattacgggaaagctgaaccgtctggtggaaaaaactaatacggagtttgagtccatagagagtgagttttctgaaattgaacaccagattgggaacgtgatcaactggaccaaggactcaatcactgatatatggacctaccaggccgagctcctagtggcaatggaaaaccagcacacaatagacatggccgacagcgaaatgttgaatctctacgaaagagtgaggaagcagcttcggcagaatgctgaggaggacggaaagggatgtttcgagatctaccacgcctgtgacgatagttgcatggaaagcatccgtaacaatacctacgatcacagtcaatatagggaagaagcattgctgaataggttgaatataaatcccgttactctttcctcggggtataaggatattatcctttggttttcatttggtgcctcgtgtttcgtcctgctggcagtggtgatgggcctctttttcttctgtttgaagaacgggaatatgcgctgtaccatctgcata

SEQ ID NO: 877 - DNA, 1683 bp, Influenza A virus
  misc_feature (1)..(1683): Codon Optimized Sequence Encoding H10 Hemagglutinin
atgtacaaagtagtcgtaatcatcgcccttttgggagccgtcaagggcctggacaagatatgcctgggacatcacgctgtcgccaacgggacgattgtcaaaacactgacaaacgagcaggaagaggttaccaacgcgactgagactgttgagtcaacaggtataaaccgactgtgtatgaaaggacggaaacacaaagatctggggaattgccaccccatcgggatgctgatcggtacccctgcatgcgacctgcacctcactggtacttgggatactctcatagaacgggagaacgcaatcgcatactgctatcctggagccaccgttaatgttgaggccttgagacaaaaaattatggagagtgggggaatcgacaaaatctccaccggctttacctatggcagctccatcaattcagccggtaccacgcgtgcctgtatgcgcaacggaggtaattcattctacgccgagctaaaatggctggtgtccaaaaataaagggcaaaacttcccgcaaacaacaaacacttacagaaacacagacactgcagaacatctgataatgtggggaatccaccatccgtcatctatacaggagaaaaacgatctgtatggcactcagtcactcagtatctccgtcggctcatcaacgtacaggaataattttgtgcccgtcgtcggcgcacgtccacaagtcaacggtcagtccgggagaatcgactttcattggacgcttgttcaaccgggcgataacattacattttcacataacggagggctcatcgctccaagtagagtctctaaactgatcggacgtggcctgggaattcagtcagatgcgcccatcgacaacaattgcgagtcgaagtgcttctggcggggggggtccataaatacccgcctcccctttcaaaacctctcaccccgtaccgtgggccagtgccctaaatatgtgaatcggcgatccctgatgctggcaactggaatgcgcaacgtaccagagctgattcagggcagaggactcttcggggccattgcagggttcctggaaaatggttgggaaggaatggttgacggatggtatggcttccgccaccagaatgcacaagggacaggtcaggctgcagattataagtccacgcaggccgctattgatcagattacgggaaaactcaacagactggtggaaaaaaccaacactgagtttgagagcattgagtccgagttttccgagattgaacatcaaatcggtaatgttatcaattggactatggatagtattacggatatttggacttaccaggccgaattgttagtggctatggaaaaccaacacactattgacatggcagactcagagatgctcaatctttatgagcgcgtgaggaagcagctcagacagaacgcggaagaagacggcaaggggtgctttgagatttaccacgcctgcgacgactcctgcatggaaagcatccgcaacaacacctacgaccacagccaatatcgcgaggaggccctccttaatcggttgaacatcaatcccgtaacactgtcctccgggtacaaagacatcatcctgtggttcagttttggcgcgagctgtttcgtcttgttggctgtggtgatgggcctcgtatttttttgccttaaaaacgggaacatgcggtgtacaatctgtatt

SEQ ID NO: 878 - DNA, 1683 bp, Influenza A virus
  misc_feature (1)..(1683): Codon Optimized Sequence Encoding H10 Hemagglutinin
atgtacaaaataattgtgatcattgccctcctgggggctgtgaagggccttgacaagatctgcctaggacaccatgcagttgcaaacggaacaattgtgaagaccctaaccaacgaacaagaggaggtgacaaacgcaactgagaccgtggagtcaaccggcataaataggctttgcatgaagggaaggaaacacaaagatctcggcaactgtcatccaatcggcatgcttatcgggacgcctgcatgtgatctgcacctaactggcacctgggacacactgattgaaagggagaatgctatcgcttactgttaccctggtgctactgtgaacgttgaggctttgcggcagaaaatcatggagtcagggggcattgacaaaatctcgacaggctttacctacggctcaagcattaactccgctgggaccactagagcatgtatgagaaatggaggtaactcattctatgccgagctcaaatggctcgtgtcaaaaagcaaggggcagaacttcccgcagacgaccaatacttatcggaatacagacactgccgaacatcttattatgtggggaattcatcatccatcctcaactcaggaaaaaaacgacttgtacgggactcaatccctctccatttccgtgggcagtagcacatataggaataatttcgttcctgtcgttggggcgaggccacaagtgaatggccagagcggccgaatcgattttcattggacccttgtacaaccaggggacaatatcactttctcacacaacggagggttgattgccccatcccgcgttagtaagcttatcggccgcggcctgggtatacagtccgatgcacccatcgataataattgtgagtctaagtgtttttggcgaggtggctccatcaatacgcggctaccttttcagaacctgtcgcctcgcaccgtagggcagtgtccaaagtatgtcaatagacggtctttgatgttggccaccggaatgagaaacgttccagagctgattcaggggcgcgggctgttcggcgccatcgccggcttccttgagaatgggtgggagggcatggttgatggatggtacgggtttcggcaccagaacgcccaggggaccggccaagccgcagattacaagagcacccaggctgccatcgaccagattaccggcaagctcaataggctcgtggaaaaaactaacaccgagtttgagtctatcgaatcggagtttagcgagatagagcatcagattggaaatgtcataaattggacaaaagacagtatcacagatatctggacataccaggctgagctgctggtcgctatggaaaatcagcacactattgatatggccgattcagaaatgttgaacctgtatgagcgggtgcgtaagcagctccgacagaatgctgaggaagatgggaagggctgcttcgagatataccacgcttgtgatgactcttgcatggagagcatccggaacaacacgtatgaccatagtcagtatcgggaagaggcactgctcaacaggctgaatatcaatcccgtgacgctctcatctggatacaaggacatcatcctgtggttcagctttggggcatcttgtttcgtacttctggctgtcgtcatgggcctgtttttcttctgcttaaagaacggaaatatgagatgtaccatatgcata

SEQ ID NO: 879 - DNA, 1683 bp, Influenza A virus
  misc_feature (1)..(1683): Codon Optimized Sequence Encoding H10 Hemagglutinin
atgtataaagtggtagtcatcatcgcgttactgggggcagtgcgaggccttgataaaatttgtctgggacatcatgccgtcgccaacggcaccatcgtcaagacactaactaacgagcaggaggaggtcaccaatgccaccgagaccgtcgaaagtaaatcgttgggaaagctatgcatgaaggggaggtcctacaacgacctgggtaattgccatcctattgggatcctcatcggtacccccgcatgtgacctgcacctgacaggcacatgggatactctgattgaaagagagaacgctgtagcgtactgctaccccggcgcaactgtcaacgaagaagcgctgagacagaagatcatggaatccgggggcatttcaaagatctctaccggtttcacgtatggaaccagtatcaacagcgcaggcacaacaaaggcctgcatgcgcaatggcggcaattccttctacgccgagcttaaatggctcgtcagtaagaataaaggccagaattttccccagaccaccaacacttaccggaacactgacacggccgagcatctcattatttgggggattcatcatccaagctcgactcaagaaaagaatgatctgtatggcactcagtctctgtctatctcagttggcagctccacgtaccagaataatttcgtgcctgtcgttggggctagaccccaagtgaatggacaatcaggtaggatagattttcactggaccttattacagcctggagataacataacattcagtcacaatggaggattaatagctccatcccgcgtgtctaaactgatcggcagaggcttgggcatccagtctgaagcccctattgacaatggttgcgagagcaaatgcttttggaaaggcggaagcattaacacaaagttgcctttccagaacctgtctccccgcactgtgggccagtgtcccaagtacgtcaataaacgatctctgatgctggctaccggtatgcgcaatgttcccgaaatcatgcatgggagagggctgttcggggctatagcaggatttatcgaaaatggatgggaagggatggtggatggatggtacggtttcagacaccaaaatgcccaggggacggggcaggctgctgattacaaaagtacgcaggccgccattgatcagattaccggcaagcttaatcggctgattgaaaaaacgaacaccgagtttgagagcatcgagtccgagtttagcgagattgagcatcaaattggcaacatcatcaactggacaaaagacagcatcactgatatctggacttaccaagctgaactgctcgtggccatggagaatcagcacaccattgacatggcagattccgagatgctaaacctgtacgaacgcgtccgcaagcagctccggcagaacgcagaggaagatggaaaggggtgcttcgagatttaccacgcttgcgatgacagctgtatggaatccattcgaaacaatacatacgatcactcacagtatcgcgaggaggctctgctcaaccgtttgaatattaatccagtgaagctatctagcggctataaggacataatcctgtggttcagcttcggcgcctcttgcctaatcttactcgccgtcgtgatgggactggtgtttttttgtctcaagaacggcaacatgaggtgcaccatatgcatc

SEQ ID NO: 880 - DNA, 1683 bp, Influenza A virus
  misc_feature (1)..(1683): Codon Optimized Sequence Encoding H10 Hemagglutinin
atgtataagatcgtggtcataatcgccctgctgggcgccgtcaaagggctggacaaaatatgcctcggacaccatgctgtcgccaatgggacgattgtcaaaacgctcaccaacgaacaggaggaagttactaacgccacagaaacggtagaatccacagggatcaatcgattgtgtatgaagggtcgtaagcacaaagacttgggaaactgtcaccccatcggcatgctgatcggcacgcctgcctgcgatctacatctgacaggcatgtgggacacactaatagagagggaaaacgcaatcgcctactgttaccccggtgccacagtaaacgtggaagctctgcggcagaagataatggagtctggaggaatcaataaaatcagcaccggtttcacatatggctccagtatcaactccgcaggcactaccagggcttgcatgcgcaatgggggaaattctttctacgcggagctaaaatggttagtctctaagtccaaaggacagaactttccacagacaacaaacacctacaggaatacagataccgctgagcacctgatcatgtggggtattcatcatcccagttctactcaggaaaagaacgatctgtatgggacacagtcgctgagtatatctgtcggtagtagtacataccgtaataatttcgtgcccgttgtaggcgctagacctcaggtgaatgggcaatccggccggattgatttccactggactctcgtgcagcctggggataatatcacgtttagccacaatggaggtctaatcgccccctcccgggtttctaaactgattggccggggactgggaatccaatctgacgccccaatagacaacaactgcgaatccaagtgtttctggcggggcggctccataaatacgcgacttcccttccagaacttaagtccccggactgtgggtcagtgtccaaaatacgtgaatcgccggagtcttatgctcgccacaggcatgcgtaacgtcccggaacttatacagggccggggactgtttggagctatcgcaggattcctggagaacggatgggagggaatggtggacggatggtatggtttccggcaccaaaacgctcaaggaacgggccaggcagcagattataagtcaacacaggccgcgatcgaccaaattactggcaaactcaataggctggtcgagaaaaccaacactgagtttgagagcattgaatccgaattcagcgaaatcgaacaccagatcggcaacgtgataaattggacgaaagattccattaccgacatttggacataccaggccgagttgctggtcgctatggaaaatcagcatacgattgatatggccgatagtgagatgcttaacctgtatgaacgcgtacgcaaacagctgcgccaaaatgctgaagaggacggtaaaggctgctttgagatttatcacgcttgcgacgattcatgcatggaaagtatcagaaacaatacatatgaccacagccagtacagggaggaagcgctgctcaatcgactaaacatcaatcctgtgaccctgtcgagtggctataaagacataattctatggttttcattcggagcatcttgcttcgtcctgctcgcagttgtgatgggactcttcttcttttgtctgaaaaatggtaatatgcggtgtaccatctgcatt

SEQ ID NO: 881 - DNA, 1683 bp, Influenza A virus
  misc_feature (1)..(1683): Codon Optimized Sequence Encoding H10 Hemagglutinin
atgtacaagatcgtggtgatcattgctctgcttggagccgtcaagggcctggataagatttgcctgggacatcacgctgtcgcaaatggcaccatcgtcaagactttaacaaacgagcaggaagaggtgactaatgccactgagacagtagagagcactgggataaataggttgtgcatgaaggggagaaagcacaaggacctcggaaactgccacccaattggtatgctaatcggcactccagcttgcgacttgcatctgactggcatgtgggatacgctgatagaacgtgagaatgccatcgcctactgttatcctggggctactgtgaacgtcgaggctttaagacaaaagatcatggaaagtggcggcatcaacaagataagtaccgggtttacctatgggagtagtattaattcagcaggcacaactcgggcctgcatgcggaatggggggaacagcttctacgccgagctaaagtggcttgtgagcaagtccaaagggcagaatttcccgcagaccaccaatacttaccgcaacaccgatactgcagaacacttaataatgtggggcatccaccatcctagtagcacgcaagagaagaatgacttgtacggtacccagtcgctaagtatcagcgtgggcagttcgacatatagaaataactttgtccctgttgtgggcgcgcgccctcaggtaaatggacagtctggtcggatcgactttcattggaccctggtgcagccaggggacaacattaccttttcacataatggcggtctcatcgcacccagtcgggtctcaaagctgatcgggcgggggctgggcattcagtcagacgctcccatagataataattgcgagtccaagtgtttctggagagggggctccatcaatactaggctgccttttcagaacctctcgccccggactgtggggcagtgccccaaatacgtaaaccgaagatccctaatgctggctactgggatgcggaacgtacctgaactgatccagggacgtgggctattcggagccatagctggatttctggaaaatggctgggagggaatggttgatgggtggtacgggtttcggcaccagaatgcccagggcactgggcaggctgccgactacaaatcaactcaggccgctattgatcaaattacaggtaagctcaaccgtctagttgagaaaacaaatactgagttcgaaagcattgagtctgagttttccgagattgagcatcagatcggcaacgttattaattggacaaaggacagcatcactgacatttggacataccaggctgaacttctggttgcaatggaaaatcagcacactatcgacatggctgattccgagatgctaaatctctacgaacgggtcagaaagcaactgcggcagaatgccgaggaagatggaaaaggctgtttcgaaatttaccatgcttgcgacgactcctgtatggagtcgatcaggaacaacacctacgatcacagtcagtatcgtgaggaggcacttttgaaccgtctgaacatcaaccccgtgaccctttcctccgggtataaagatatcatcctctggttctccttcggagcatcttgcttcgttctcctggccgtagtgatgggcctgttttttttctgcctgaagaatgggaacatgagatgcaccatctgcatt

SEQ ID NO: 882 - DNA, 1683 bp, Influenza A virus
  misc_feature (1)..(1683): Codon Optimized Sequence Encoding H10 Hemagglutinin
atgtataaaatcgttgttattatcgccttattgggcgctgtgaaagggctggataaaatctgcttagggcatcatgccgttgctaatggaacgattgtcaaaaccctgacaaatgagcaggaagaggttacaaacgctactgagacagtggaaagcaccgggataaaccggttatgtatgaaaggtcggaagcacaaagacctaggaaactgccacccaatcggcatgctgattggtaccccagcatgtgatctgcacctaacaggaacctgggacacactcatcgagcgggaaaacgccattgcctattgttatcctggcgccacggcaaacgtggaggcgctgcgccagaagattatggagtccggaggtatcgacaaaatctctaccggctttacgtacgggagttcaattaattcagccggaacaaccagggcctgtatgcgcaatggggggaattcattttatgccgaattgaagtggctcgtctccaagagcaaaggacagaactttcctcagacaacgaatacttacagaaacaccgataccgctgagcacttaattatgtggggaatccaccatcctagttcaatccaggaaaaaaacgatctgtacgggacacagagtctctctatatctgttggatcttccacctataggaacaattttgttcccgtggtgggcgccaggccacaggtgaatggccagtccgggagaatagattttcactggacccttgtccagcctggggataacattactttcagccacaacggaggcctcatcgcgccaagtagggtttccaaattgatagggagaggcctggggattcagtccgacgcccccatagataataattgcgaatcaaagtgtttttggaggggggggtccatcaacacaagactcccctttcagaatctgtcaccccgaaccgttggccagtgtccgaaatatgtgaaccggaggtccttaatgctggccactggaatgcggaatgtgccagagcttatccaaggaaggggactgtttggagcaatcgccggcttcctagaaaatggctgggagggtatggtggacggctggtatgggtttagacatcagaatgcccaaggaaccggtcaggctgcggactataagtccacccaggccgctatcgaccagatcacaggtaagctcaacaggctggtcgagaaaacaaatacagagttcgagtccatagagtccgagttcagcgaaatagaacaccagattggaaatgtgattaactggacgatggattccatcacagacatctggacctaccaggcagagttactggtagctatggaaaatcagcatacaatcgacatggccgactctgaaatgctaaatctttacgagagagttcgtaaacagcttcgccagaacgccgaggaagatgggaaagggtgctttgaaatatatcacgcctgtgatgatagctgtatggaatcaattagaaataacacatatgaccattctcagtacagagaagaggctctgctcaataggctcaatatcaatccagtgaccctatcctcaggatacaaggacatcatactctggttcagttttggcgcctcttgtttcgttctgttggccgtcgtcatgggcctcgtgtttttttgtttaaagaacggcaatatgcgatgcactatttgcatc

SEQ ID NO: 883 - DNA, 1683 bp, Influenza A virus
  misc_feature (1)..(1683): Codon Optimized Sequence Encoding H10 Hemagglutinin
atgtataagattgtagtgatcattgctctgctcggggccgtgaagggcctggataagatctgcctgggtcaccatgccgtcgcaaacggcacgattgtgaaaacactgacgaatgagcaggaggaggttactaacgctacagagacggtcgagtcaactggaattaaccggctttgcatgaaaggacgaaaacacaaagatcttgggaactgccacccaattgggatgctgattggaaccccagcctgtgatctgcacttgacaggcatgtgggacactctgatcgagagggagaacgcaatagcctattgctaccctggcgcaaccgtgaacgtggaggccttgcgccagaagataatggagtctgggggtatcaacaagatcagtacaggtttcacttacggcagttctattaactctgccggaaccacaagagcatgcatgcgtaacggaggcaattccttctatgccgaacttaaatggcttgtctccaagtctaaggggcagaacttcccccagacaacgaacacttaccgcaatacggacacagcagaacacttaatcatgtgggggatccatcatcccagcagtacacaggagaaaaatgacttatacggaactcagagcttaagtatctccgtgggcagtagtacttacagaaacaatttcgtccctgtcgtaggcgctaggcctcaggtgaatggccagtctggacgcatcgacttccactggactctggttcaaccaggggacaacatcactttctcgcacaacggagggttgatcgcacccagtcgggtgagtaaacttatcgggagaggcctcggaatacaatccgatgctcccatcgataataattgcgagagcaaatgtttttggcgcggagggagcattaatacacgcctgccttttcagaacttgtcaccacgaaccgtgggccaatgccccaagtacgtcaacagaagatcattgatgctggctactggcatgaggaatgtgcctgaattaattcaaggaagaggactgttcggcgccatcgcaggttttcttgagaatgggtgggaggggatggtggatggttggtatggctttcgccaccagaatgcgcagggcacagggcaggctgctgattacaagtcaacccaggcagccatcgaccagattactggcaagctgaataggctcgttgaaaaaaccaacacagagttcgagtcaattgagagcgagttttctgaaatagagcatcagataggcaacgtgataaattggaccaaagacagtatcacagacatttggacttatcaagcagagttgttggtagccatggagaatcaacacacgatcgacatggccgatagcgaaatgctaaacctgtatgagcgcgttcggaagcagctgcgccagaacgcagaggaggacgggaagggctgtttcgaaatttatcacgcttgtgacgacagttgcatggaatccatccgcaacaatacgtatgatcactcccagtatagagaagaggccctcttgaatagactgaacatcaacccagtgactctgagctcaggttacaaggacattattctctggttttctttcggagcttcctgctttgtcctcctcgctgtcgtaatgggactctttttcttttgcctgaagaacgggaatatgagatgcaccatttgcatc

SEQ ID NO: 884 - DNA, 1683 bp, Influenza A virus
  misc_feature (1)..(1683): Codon Optimized Sequence Encoding H10 Hemagglutinin
atgtataagattgtcgttatcattgcactgcttggtgcagttaaagggctggataagatttgtctagggcaccatgccgtggccaacgggaccatagtgaaaacactgaccaatgaacaggaggaagtcaccaatgctactgaaactgttgaatccaccggcattaaccggctgtgtatgaagggccgcaaacacaaggacctgggcaattgtcaccccatcggcatgttgattggcacccctgcatgtgacttgcacctcactggcatgtgggacacactgatcgaacgagagaatgcaattgcctactgctaccctggtgccacagtgaacgtggaggctcttcgacaaaagatcatggaaagcgggggcatcaataagatttctacagggttcacatacggttcatctattaacagtgcaggaacgacccgggcctgcatgcggaacggcggcaattcattctacgccgaattgaagtggttggtgtcgaagagtaagggccagaatttcccgcagacaacaaacacatatcgcaatacggatacggccgaacacttaatcatgtggggaatccatcacccttcttctacccaagaaaagaacgatctatacggcacccagtccctgtcaatttcagtgggttcttcgacatacaggaacaatttcgtccctgttgtcggcgcacggccccaggtaaatgggcagagtgggagaatcgacttccactggactctggtgcagcctggggataacattacgttcagtcacaatggcggcctcatagccccatcacgggtgagcaaactaataggacgaggcctgggaatacagtccgacgccccaatcgataacaactgcgagtcaaaatgtttctggcgaggaggcagcatcaatacaagactcccttttcagaatcttagtccaaggacagtcggacagtgcccaaaatacgtgaatagacgcagcttgatgttggcaacggggatgcgcaatgttcctgagctcatacagggtagaggcctatttggggccatcgcaggcttcctggaaaacggatgggagggcatggtggacggatggtacggatttcgtcaccagaatgctcaaggcacaggtcaggctgccgactacaaatctacccaggccgccatcgaccagattaccggaaaactgaacaggttggtggaaaaaacgaatacagaattcgagagtattgagagtgagttctccgagatcgagcaccaaatcggcaatgtgattaattggacaaaagactccattaccgacatctggacttaccaggctgagttgctcgtggcgatggaaaaccagcataccattgatatggccgatagtgaaatgctgaatctgtacgaacgcgtcagaaaacagctacgacagaacgcggaggaggatgggaagggctgcttcgaaatctaccacgcttgcgatgattcctgcatggagtccattcggaataacacgtacgaccatagccaatacagggaggaggcgctcctaaataggttgaacataaatccagttaccctttcttccggttacaaggatattatcctgtggttctcctttggcgcctcttgtttcgtccttctcgccgtggtgatgggattatttttcttctgcctcaagaatggaaatatgcggtgtacgatctgtatt

SEQ ID NO: 885 - DNA, 1683 bp, Influenza A virus
  misc_feature (1)..(1683): Codon Optimized Sequence Encoding H10 Hemagglutinin
atgtacaaagtggtggtgataattgctctcctcggcgccgtgaaaggcctcgacaagatatgtctgggccatcatgcagtcgccaacgggaccatcgtcaagaccctcaccaatgaacaggaggaggttaccaacgccactgaaacagttgagtctactggaatcaatcgactgtgtatgaaggggagaaaacacaaggacctcggtaactgtcatcctattgggatgcttattggaacaccagcctgtgatttacatctgacgggcacctgggacaccctgatcgaaagagagaacgcaattgcatattgctaccctggcgctacagttaatgttgaagctctgaggcaaaaaatcatggagtccgggggaatcgacaagatttcaaccggcttcacgtacggcagttctatcaacagcgcaggtaccacaagggcctgtatgaggaacggcggaaatagcttttacgccgaactgaaatggctggtgtcaaagaacaaaggacagaacttccctcagaccacaaacacataccggaatacagacaccgcagagcaccttataatgtggggcatccatcatccctcctctattcaggagaagaatgatctgtacggtacacagtcactctccatctctgtaggcagctccacatatcgtaataactttgtcccagttgtgggagcccgaccacaggtgaacggccaatcaggacgaattgattttcactggaccctcgtgcagcctggcgacaacataacattcagccataatggaggactcatcgccccgtcccgcgtgtctaaattaatcggtcgggggctggggatccagtccgatgcgcccatagataacaactgcgagtctaaatgcttctggcggggcgggtccattaacactcgactgcccttccaaaatctcagcccacgcacagtaggccagtgtccaaaatatgtcaatagacgttctctaatgctcgccaccggaatgagaaatgtgcctgagctgattcagggaaggggattgtttggagctatagccggattcttggagaatggttgggaaggcatggtcgacggatggtatggattcagacaccagaacgctcaaggcacgggccaagcagccgactacaaatccacccaagcagccattgatcagattacagggaagctgaacaggctggtggagaagacaaacacagaattcgaaagtattgagagcgaattttccgagatcgagcaccagatcggtaatgtgatcaattggaccatggacagcataacggacatctggacctatcaggccgaactcctggtcgcaatggaaaatcagcatactatcgacatggccgatagtgagatgttgaacctgtatgagagggttcgtaagcagctccgtcagaacgcagaggaggatggtaaaggatgttttgagatctatcacgcatgcgatgacagttgcatggaatctattcgtaacaatacgtacgatcatagccaataccgcgaagaagcattgctgaaccggctgaatattaaccccgtgacattatcctccgggtacaaggacataattctgtggttctccttcggggccagctgcttcgtgctgctcgctgtggtcatgggcctggtcttcttctgcctgaaaaatggcaacatgcgatgcacaatatgcatc

SEQ ID NO: 886 - DNA, 1683 bp, Influenza A virus
  misc_feature (1)..(1683): Codon Optimized Sequence Encoding H10 Hemagglutinin
atgtacaaaatcgtcgtgatcatagcactgctgggagccgtaaagggtctcgataagatctgcctagggcaccacgcagtagccaatggaaccatagtaaaaacactcacgaatgagcaggaggaagttaccaacgccactgaaaccgtcgaatctaccgggatcaacagattgtgcatgaaagggcgcaaacacaaggatctggggaactgtcacccaatcggaatgctaattggaacaccagcctgtgatctccatttgacaggaatgtgggatacactgatagagcgtgaaaacgccatagcgtactgttaccccggcgccacagtgaacgtggaagcgttacgacaaaagataatggaatcaggaggcattaataagataagtactggctttacctacgggtcttcaatcaactctgccgggacaactagagcctgtatgagaaacggtggtaattcgttctacgctgagctgaagtggctggtgtccaagagcaaagggcagaatttcccacagactacaaacacctacagaaacaccgatacagccgaacacctcatcatgtggggaattcatcacccaagcagcacgcaggagaagaacgatttatatgggacacaaagcttgtcaatttccgtgggcagtagcacatacagaaataacttcgtgccagtggtaggggcgggtccccaggtgaatggacagtccggccgcattgatttccattggaccctcgtgcagccgggagacaacatcacattcagccacaatggtggactaatcgccccatcccgcgtctccaaactgatcgggagaggactgggtattcagtctgacgcgcccattgataataactgcgagtcaaaatgtttctggcgaggggggagcatcaatacacgattgccttttcagaacttgtcccctcggactgtcggccagtgccctaagtatgtgaataggagatccctgatgcttgccaccggaatgagaaacgttcctgagctgattcagggtcgcggtctatttggcgcaatcgccggctttctcgaaaacggctgggagggcatggtagatggttggtacggtttccggcatcagaacgcccagggaactggacaagccgctgattacaagtcaacacaggcagcaatcgaccaaattactggcaaactgaaccggcttgtcgagaaaaccaatactgaatttgagtcaattgaatccgaatttagtgaaattgaacaccagatcggcaatgtgattaattggactaaggactctattaccgatatttggacttatcaggctgagctacttgtggccatggagaaccagcacacaatcgacatggctgatagtgagatgctgaacctttacgagcgagtcaggaaacagctgagacagaacgccgaggaggatggaaaaggctgtttcgaaatctatcatgcttgcgacgattcatgcatggagtcaatcagaaataacacctacgaccacagtcagtatcgcgaggaagctttactcaacagactcaatatcaatcctgtaacattgtcttccggctacaaagacatcatcctgtggttctcatttggagccagctgctttgtcttgttggctgtggtgatgggactgttctttttttgcctcaaaaatggcaatatgagatgtaccatttgtatc

SEQ ID NO: 887 - DNA, 1683 bp, Influenza A virus
  misc_feature (1)..(1683): Codon Optimized Sequence Encoding H10 Hemagglutinin
atgtataagatcgtggtgatcattgctctcctgggcgcagtaaagggtcttgacaagatatgtcttggacaccatgcagtggcaaacggcacaattgttaaaacactcaccaacgagcaggaggaagtgaccaatgccactgaaacagtagagtccacggggatcaataggctctgcatgaaagggaggaagcacaaagatctgggtaattgccatccaatcggaatgctcataggaacaccagcctgcgaccttcatctgaccggtatgtgggatacattgatcgaacgcgagaacgcgatagcttactgctatcccggcgccacagtgaatgtggaggccctccgacagaagattatggagtcgggcggtattaacaaaatatccactggttttacttacggatcttcgatcaattccgcaggaacaacacgagcctgtatgaggaatggcgggaactctttctatgctgagcttaagtggctcgtttctaagtctaagggccagaatttccctcagacgactaatacctacaggaacacggatacagcagagcacctgattatgtggggtatccatcatccatctagcacccaagagaaaaatgatctgtatgggacccagtcactttccattagcgtgggctctagtacatacaggaataactttgtacctgtggtgggggctagaccgcaagtgaatggccagagcggccggattgacttccactggactttagtccagcctggagataacattacattttcacacaacggcgggctgattgcgcctagtagggtgagcaaacttattggacgaggattaggaatccagagcgatgcccccatcgacaacaactgcgaaagcaaatgcttttggaggggcggttcaatcaacacccgtctccctttccagaatctgtccccccgtaccgtggggcagtgtccaaagtatgttaatagaaggtcactgatgctagccactggcatgcggaatgtgcccgagctgatccagggccgtgggctgttcggtgctattgcaggatttctggaaaatggctgggaaggcatggtagatggttggtacggttttcggcaccagaacgcccaggggaccggacaggcggccgactacaaatccactcaagccgctatcgatcagattacgggaaagctaaatagactggtcgaaaaaaccaacacagagttcgaatccatagagtccgagttctctgagatcgagcaccagatcgggaatgtgatcaactggactaaggatagcattactgatatttggacctaccaggcagagctgctggtcgccatggaaaaccaacacacaatcgatatggcggatagtgagatgctgaacctgtatgaaagagtgaggaaacagctgagacagaacgcagaggaggacggaaaagggtgcttcgagatttaccacgcttgcgatgacagttgcatggaaagcatacgcaataacacttacgaccatagtcaataccgggaggaggctctcctgaataggctcaacatcaatcctgtgaccctgagttcaggttacaaagatatcatcttgtggttttcatttggggcgagctgctttgtgctgctggccgtcgtgatgggcctgttctttttttgcctgaagaatggcaatatgcgatgtaccatatgcatc

SEQ ID NO: 888 - DNA, 1683 bp, Influenza A virus
  misc_feature (1)..(1683): Codon Optimized Sequence Encoding H10 Hemagglutinin
atgtataaaatagtggtgatcatagcactcttgggagccgtaaagggactggataagatctgcctggggcatcatgccgttgccaacggcacaatcgtgaagacccttactaatgaacaagaagaagtgaccaacgctactgagaccgttgaatccaccggcattaaccgcctctgcatgaaggggcggaagcacaaagatctcggcaactgccacccaatcgggatgctgattgggacccccgcgtgcgatttacatctgacaggtatgtgggatacattaattgaaagggagaacgcgattgcgtactgctaccctggggctaccgtgaatgtcgaagcactccgacagaagatcatggaatctggggggatcaacaagatctcgaccggttttacctatgggagttctattaactctgctggcacaacacgggcatgtatgcgcaatggggggaatagtttctatgctgagctcaaatggcttgtatccaaatccaaagggcagaatttcccccagactacaaatacctacagaaacacggataccgctgagcacctaataatgtggggaattcaccatccttcctcaacccaagagaagaatgatctttacgggacccagagtctcagcattagcgtcggatcgtcgacttaccgcaacaatttcgtcccagtggtcggagccaggccacaggtcaacggccagtctggcaggatagacttccactggaccctggttcagcctggagataacattacatttagtcataacggcggcctgattgctcccagtcgcgtgtctaaactaatcggacgtggtctgggcatccaatccgatgcgccgatcgacaataactgcgaaagcaagtgcttttggaggggaggatccatcaatacacgacttcccttccagaacctatcaccaagaaccgtaggccagtgcccgaaatacgtgaatcgacggagtctgatgctggccaccggcatgagaaatgtgcctgagctgattcagggacgaggactgtttggcgcaatcgctggcttcctggaaaacgggtgggaaggaatggtcgatggctggtacggatttcggcatcagaacgcccaaggcactggccaagccgccgactacaagagtacacaggccgcaatcgaccagatcacaggtaagttgaatcgattggtggagaagaccaacactgagttcgaatctattgagagcgaattcagtgaaatcgagcatcagatcggaaatgtgataaattggaccaaggactcaattaccgacatctggacataccaagcagagcttctggttgcgatggaaaaccaacacacaattgatatggcagattccgagatgctgaacctctatgagcgcgtcaggaagcaattgaggcagaatgcagaggaagatggaaaagggtgtttcgaaatctatcacgcctgcgacgacagttgcatggaatcgatccgcaacaatacttatgaccactcacagtatagagaggaggctttgctgaaccggttaaatatcaatcctgtcacgttgagtagcggctacaaggatatcatcctatggttttccttcggggcgtcttgttttgtgctgttagcagtggtgatgggacttttcttcttctgtcttaaaaacggaaacatgagatgtaccatctgcata

SEQ ID NO: 889 - DNA, 1683 bp, Influenza A virus
  misc_feature (1)..(1683): Codon Optimized Sequence Encoding H10 Hemagglutinin
atgtataagatcgtggttatcattgccctcctgggcgcagtcaaaggcttggacaaaatctgtctcggacatcacgccgttgctaacggcaccattgttaagacccttaccaacgagcaggaagaagtgacaaatgcaacagaaacggtcgagtccacaggcatcaaccggctctgtatgaaaggtcggaagcacaaggatcttgggaattgtcacccaataggtatgctgattggcactcctgcctgcgatcttcatctaactgggatgtgggacacccttatcgaacgagaaaatgccattgcatactgttaccctggtgctactgtcaacgtggaagccctcaggcagaaaataatggagtcgggtgggataaataagataagcaccgggttcacttacggcagctccattaattccgccggaactacgcgcgcctgtatgagaaatggcggtaactccttctacgcggagctgaagtggctggtctcgaagtctaaaggccagaacttcccccaaacaacaaacacctacaggaacactgacaccgctgaacacctcatcatgtggggcattcaccacccctccagcacccaggaaaaaaacgacttatacggcacacagagccttagtataagcgtgggaagctcaacttatcgcaacaattttgttccagtggtgggcgcaagaccgcaggtgaacgggcaaagtggtcgaattgactttcactggacactcgtgcaaccaggcgacaatatcaccttttcacataacggaggactcattgccccgtcccgcgtcagtaagttaattgggcggggcctcggcattcagtcagacgcccctatcgataacaactgtgaatctaagtgcttttggagaggagggtctataaacacgagactccccttccagaacttatcgcctcgcactgtgggtcagtgtcctaagtacgttaacagacgttccctgatgctggcaacgggaatgagaaacgttccagaactgatccaggggcgcgggttatttggggctatcgctggtttcctggagaatggctgggagggaatggttgacgggtggtatgggtttcgtcaccaaaacgcccaggggacggggcaggccgcagattacaagtctactcaggcggccatagaccagattacaggcaagctgaatagactggtcgagaagacgaacacggagtttgagtctattgagtccgagttcagcgagattgaacatcagataggtaatgttatcaattggacaaaggatagcataaccgatatttggacataccaggcagagttactggttgcaatggaaaatcaacacactattgacatggctgactcagagatgctcaacttatacgaacgagtgaggaagcaactacgacagaacgccgaagaggacggaaagggttgctttgagatctaccacgcctgcgacgatagctgcatggagagcatcaggaataatacttacgatcactcacagtacagggaggaagccctcttgaaccgtctgaacataaatcctgtcacacttagctccggctacaaagatatcatcttgtggttttcatttggcgcgtcatgttttgtgctcctagctgtggtcatgggcttattctttttctgcctgaaaaatggcaatatgaggtgcacaatttgtatc

SEQ ID NO: 890 - DNA, 1683 bp, Influenza A virus
  misc_feature (1)..(1683): Codon Optimized Sequence Encoding H10 Hemagglutinin
atgtacaagatagtggtaattatcgcgctgttgggcgcagtgaaaggactggacaagatctgcctgggtcaccacgccgtggccaatggaacgattgtgaaaaccttgacaaacgaacaggaggaagtgaccaacgcaacggagactgtggaatcaactggtatcaatcggctatgcatgaaaggcagaaaacacaaagatttgggcaattgccatcccatcggtatgctcattggaacacccgcttgcgacctccacctgactgggacgtgggatactttgatcgagagggagaatgctattgcctactgttaccctggcgcaacagctaatgtggaggccctccggcagaagatcatggagagcggtggaatcgataagatttcaactggcttcacatacggctcctcgatcaattctgccggcactactcgggcttgcatgagaaacggaggaaatagtttctatgctgagctgaagtggcttgtgagtaaatctaaaggccagaactttccccagacaaccaacacataccggaataccgacaccgcagaacatctgattatgtgggggatacatcacccatctagcattcaggagaaaaacgacctgtatggcactcagtccctgagcatttccgtaggctctagtacctaccggaacaatttcgtacccgtcgtaggcgcccgcccccaagtgaacggccagtccggtcgaattgacttccactggacactagtgcagcctggggacaatatcacatttagtcataacggcggactgatcgccccatcgagagtgtctaaactgatcggacgcgggctgggtattcaatcagatgcccccatcgacaacaactgcgaaagcaaatgcttctggcgcggcgggagtataaacacccggcttccatttcagaacctctctcctcggaccgtcggacagtgcccgaaatatgtgaaccgcaggtcactgatgttggcaactggaatgaggaatgtccccgaattaatacagggccggggcttattcggagccatcgcaggcttcctggagaacggttgggaaggcatggtggatggatggtatggatttagacatcaaaatgcacagggaacaggccaggctgccgactacaaatctacccaggccgcgatagatcaaattacaggaaagttgaacaggctggtggaaaagactaataccgaatttgaatcaatcgagtccgaattctccgaaatcgaacaccagatcgggaatgtcattaactggactatggattctataaccgatatctggacataccaggcagaactgctagtagccatggaaaatcaacacacgatcgacatggctgactcagagatgctgaacctctacgagcgggtcagaaaacagctccgacagaatgcagaggaagacggaaaaggctgttttgagatttaccacgcttgcgacgactcttgtatggagtccatacggaataatacgtacgatcactcacagtatagggaggaggccctactgaatagactgaacatcaaccccgtcacgctgtctagtggctataaagacatcattttgtggttttctttcggagcaagttgcttcgtgctcctcgccgtggtgatgggactcgtgttcttctgcttgaaaaatgggaatatgcgatgtaccatttgcatc

SEQ ID NO: 891 - DNA, 1683 bp, Influenza A virus
  misc_feature (1)..(1683): Codon Optimized Sequence Encoding H10 Hemagglutinin
atgtataaaattgtcgtgataatcgctctgcttggcgctgtgaagggcttagataagatatgcctcggacaccatgcagttgccaatggcacgatagtgaaaacattgaccaacgagaaagaagaggtgaccaacgctaccgagactgtggaatccaccggtctgaatagactctgcatgaaggggcggaagcataaggacttgggcaattgtcacccaattgggatgctcatcggatcgcccgcatgtgacctgcatctcactgggacctgggacacattgattgaacgagagaacgctattgcgtactgctacccgggagccactgttaatggtgaagcacttcgccagaagatcatggagtccggaggcatcgacaagatcagcactggattcacctatgaaagttccataaactccgcaggcactacaagagcttgcatgaggaacggcgggaattcattctacgctgagctcaagtggctggtgagcaaatctaagggacagaattttccacagacaaccaacacgtatcgaaacaccgatactgcagagcaccttattatgtggggcattcaccatccatccagcacgcaggagaaaaacgatctgtacggtacccagtctctgtctatctccgtgggatcttccacctatagaaacaatttcgtacccgtagtgggggccaggccgcaagtcaatggccaatctggccgcatcgacttccactggaccttggtacagcctggcgacaatatcacattctcacacaacggcggcttgattgctccgagccgggtgtctaagttgatcggaagagggctcggcatccagtctgatgcccctatcgataacaactgtgaaagtaagtgcttctggcggggcggaagtattaataccaggctgccattccagaatctttccccccgcaccgtcggtcaatgtcccaaatacgtgaacaagcgaagcctgatgttggccactgggatgcgaaatgttcctgagctgatgcagggacgaggactgttcggagccattgctgggttcctcgagaacggctgggagggcatggttgacggttggtacggattcagacaccaaaacgcgcagggcacgggtcaagccgccgattacaaatctacacaggcggcgattgaccagattacaggtaagctgaatagactcgtggagaaaacaaacaccgaattcgagtcaatagagtccgagttctctgagatagaacaccagatcggcaatgtaatcaactggacgaaagactctattacagacatttggacctaccaggcggaactcctggtggctatggagaaccagcatactattgatatggctgactctgagatgctgaatctgtacgagcgcgtccggaagcaactgcgtcagaatgcagaggaagacggaaaggggtgctttgagatttatcacgcctgcgatgatagctgtatggagtcaatccgaaacaacacttatgatcatagccagtaccgtgaggaggcactactgaacaggctgaacattaatcccgtcaccctgagcagtggctacaaagacatcatcttgtggttctctttcggcgcctcatgctttgtcttgcttgccgtagtcatgggtttagtgtttttttgtctcaaaaacggtaatatgcggtgtacaatttgcatc

SEQ ID NO: 892 - DNA, 1683 bp, Influenza A virus
  misc_feature (1)..(1683): Codon Optimized Sequence Encoding H10 Hemagglutinin
atgtacaaaatcgtggtaataatcgcgcttctgggcgcagtgaagggcctggacaaaatctgcctgggacatcacgctgtggcaaatgggaccatcgtgaaaaccctcaccaatgagaaagaggaagtgaccaacgccacggaaacagtagaaagcacaggattaaaccggctttgcatgaaaggccgcaagcacaaagacctgggcaattgccatcccatcgggatgctgatcggatcacccgcctgtgatctccatctaaccggcacctgggacactctgatcgaaagggagaacgcgatcgcttactgctacccaggcgctaccgttaatggcgaggctttgcgccagaagatcatggagtcaggagggatcgacaagattagtacaggcttcacctatgagagctcgatcaattccgcaggaacaacccgggcctgcatgagaaacggcggcaattccttttacgccgaacttaagtggctggtgagtaaaagcaagggacaaaacttcccacagaccaccaacacctaccgtaataccgataccgctgagcatttgatcatgtggggaattcatcatcccagctccacacaggagaagaatgatctttacgggacacagtcactcagcatttccgtcggttcgagcacttaccggaataattttgtccctgtggtcggcgcccgccctcaggtcaacgggcagagcggcaggatcgacttccattggacactagttcagcctggcgacaatattacctttagccacaacggcggtctgatcgctccttcgcgtgtctcaaaactgatcggtcgggggttaggcattcaaagcgatgcccccattgacaacaattgtgaatcaaaatgtttctggcgcggtggctccattaacaccagactgcctttccagaatcttagcccaagaacagtcggccagtgccccaagtatgtgaataaaaggtctctgatgctggctaccggcatgcgtaatgtcccagagcttatgcaaggcagaggactgttcggcgcaatcgcgggttttcttgagaacggatgggagggtatggttgacggatggtacggtttccggcaccagaacgcccagggaactggccaggccgcagactacaagtccacacaggcggcaattgaccagatcactggcaaacttaaccgtctagtggaaaaaaccaacactgaattcgagagtatcgagagtgagttctccgagattgagcatcagatagggaacgtgatcaattggacaaaggactctattacagacatttggacttatcaggccgagctgctggtggccatggagaatcagcacacaatcgacatggccgactctgagatgctcaatctttatgaacgggtgcgcaaacagctgcgacagaatgcagaggaggatgggaaggggtgcttcgaaatctatcacgcatgcgacgattcatgtatggagtccatccggaataatacatacgatcatagtcagtatcgcgaggaagccttattgaacaggctgaacattaatccagtcactctcagctcagggtacaaggacatcattttgtggttctcatttggagcatcgtgcttcgtgctccttgcggttgtcatgggtctggtctttttttgcctgaagaatggaaacatgagatgcaccatatgtatc

SEQ ID NO: 893 - DNA, 1683 bp, Influenza A virus
  misc_feature (1)..(1683): Codon Optimized Sequence Encoding H10 Hemagglutinin
atgtacaagatcgtggttattatcgccctcctgggtgctgtgaaaggactggataagatctgtctgggacaccatgctgtggcaaacggcactattgttaaaactctgactaacgagcaagaagaagttactaatgctactgagacggtcgaaagtactggaatcaatcggctttgcatgaagggccggaagcacaaagaccttgggaattgccatcctattgggatgctgatcggtacccccgcatgtgacctccatctgactgggatgtgggacacgctcatcgagagggagaatgccatcgcttactgttatcccggagccacagttaatgtcgaagccttacgacaaaaaatcatggagtcaggtggtatcaacaagatcagcaccggtttcacatacggctcctccatcaactcagcaggtactacacgcgcatgcatgcggaacggcggaaacagtttctacgccgagctgaagtggcttgttagcaaatcaaaaggtcagaatttccctcagactacaaacacataccgtaacaccgataccgcagaacatctcatcatgtggggtattcatcacccaagttccacacaagaaaagaacgatctctacgggactcaatcactctccatctccgtcggatcctctacataccgtaacaactttgttcctgtggtgggcgcaagacctcaggttaatgggcagtcaggtagaattgacttccattggacactggtgcaacctggggacaacatcaccttctcccacaacggcggtctgatcgcgccctcaagggtctccaagctgataggtcggggcctcggcatccagagcgacgccccgatcgataacaattgtgaaagcaaatgcttctggagggggggctctatcaacacacgactgcctttccagaatctctctccccgaaccgtgggacagtgtcctaaatacgtcaacaggaggagcctgatgctcgccacaggtatgcgtaatgtcccagagctgattcaaggccgcgggttatttggcgcgatagccggttttctggagaacggctgggagggaatggtggatggctggtatggattccggcaccaaaatgctcagggaactggtcaagcagccgactataaatccacgcaggccgccatcgaccagattactggcaaattaaatcgcctcgtggagaagactaacactgagttcgaatccatagagtcagagttttccgagatcgagcaccagatcggtaatgtgattaattggaccaaagattccatcactgatatttggacataccaagccgagctcttggtggctatggagaaccaacatactatcgatatggccgatagcgaaatgctcaacctgtacgagagggtcaggaaacagcttcgccagaacgcagaggaagacggcaaaggatgtttcgagatttaccatgcgtgcgacgattcttgcatggagagcattcggaacaacacgtatgatcacagccagtacagggaagaggcacttctgaaccgcctgaacataaatccagtcacattgagcagcggctacaaagacattatactctggttttcatttggggcctcttgcttcgtcctgctggcagtggtgatgggattgttcttcttttgcctcaaaaacggtaatatgcgctgcaccatttgcatc

SEQ ID NO: 894 - DNA, 1683 bp, Influenza A virus
  misc_feature (1)..(1683): Codon Optimized Sequence Encoding H10 Hemagglutinin
atgtataaaatagtggtcattattgctcttctcggtgcagttaagggtctggataagatctgcttgggccatcacgctgttgccaatgggaccatagtgaagaccttgacaaacgaacaggaagaagtgacaaacgccaccgaaaccgtcgaatccactggcattaaccggctgtgcatgaaggggcgaaaacacaaagacctcggtaattgtcatcccatagggatgctgattggtacacctgcctgtgacctgcacctgaccggaatgtgggatacgctcattgaacgagagaatgccatcgcctattgttatccgggtgcaactgtgaacgtggaggccctgcgtcaaaagatcatggaaagcggggggataaacaaaatctcgaccggtttcacgtatggttcaagcattaacagtgccggcacaacaagggcatgcatgcgcaatggaggtaactcattctacgccgagctcaagtggctcgtgagcaagtccaaaggacagaacttccctcagactaccaatacctaccgtaatactgacacagcggaacatctgataatgtggggcattcaccatccttcctcgacccaggaaaaaaacgacctgtacggaacccagtctctcagcatctccgtcgggagtagcacttaccgcaataactttgtgcccgtcgtgggagcccgcccccaagtgaatggacagagcgggaggattgatttccactggaccctcgtgcaaccgggggacaatattactttcagtcataatggaggactgatcgcccccagtcgcgtgtccaaactgatcggaagggggctcggtatccaatccgatgcaccgatagataacaattgcgagtctaagtgtttctggcgtggaggcagtattaacactcggttaccttttcaaaatctttcgccgcggaccgttggccagtgccctaagtacgtcaatcgtaggtccctcatgctagccactggaatgcgcaacgtcccggagctcatccaggggcgtggattgtttggagctattgctggcttcctggagaatggctgggagggaatggtcgatggctggtacgggtttcggcatcagaacgcacagggcacaggccaggccgccgactacaagtctacacaggccgccattgatcagatcaccgggaagctgaaccggctggttgagaagaccaataccgaatttgagagcatcgaatcggaattctcggaaatcgagcaccagattggtaacgtaataaactggacaaaggattccattacggacatttggacgtatcaagcagaactgctcgtggccatggagaaccaacacacgattgatatggcagattcagaaatgctaaacttgtacgaacgggtcagaaagcagctgcgtcagaatgctgaggaggacggcaagggatgttttgagatctaccatgcttgcgatgattcttgtatggagtccattcggaataacacgtacgaccattcacaatatcgggaggaagcacttttaaaccggctgaatatcaatccagtcacactgagttcaggctacaaggatatcatattatggttctcattcggtgcctcatgcttcgtccttttggcagtggtgatgggtttgttctttttttgtctgaagaatggcaacatgagatgtacaatatgcatc

SEQ ID NO: 895 - DNA, 1683 bp, Influenza A virus
  misc_feature (1)..(1683): Codon Optimized Sequence Encoding H10 Hemagglutinin
atgtacaagattgtggtgatcatcgcactccttggagctgtgaaaggactggacaaaatttgtctgggacatcacgctgtggctaacgggaccatcgtgaaaaccctaacgaatgagcaggaagaagtcacaaatgcgacagagacagtggaatccactggtatcaatcgactgtgtatgaagggcagaaaacacaaggacctgggcaattgtcatccgataggcatgttaatcgggacaccagcctgtgacctgcatctgaccggcatgtgggatactcttattgagcgggagaacgcaatagcttactgctacccaggcgctactgtgaatgtggaagctctgcgtcagaaaattatggagagcggagggattaacaaaatctctactggtttcacatacggcagcagtattaactcagccggcaccaccagggcgtgtatgcggaatggtggaaactcattttatgctgagcttaaatggcttgtctcaaagtcgaaaggccagaacttcccccagactacaaacacctacaggaatacggatacagccgagcatctcattatgtggggaatacatcatcccagcagtacccaggagaaaaacgatctgtacggaacccagagtctctcaatctcagtgggatcaagcacgtacagaaataatttcgtccctgtggtgggagccagaccccaggtaaatggacagtcagggcgcattgactttcactggactctcgtccagccaggagacaatatcacatttagtcacaatggcggcctgatagctccttctcgagtgagcaaactgatcggacggggtctcggtatccagtccgacgcccccatcgataacaactgcgagtcgaagtgcttctggcgtggcgggtcaattaacacaagactaccatttcagaacctttcacctagaaccgtgggacagtgcccaaagtacgtcaatagacggagcctgatgctggccacagggatgaggaacgttcctgaactgatacaaggtcgggggcttttcggtgccatcgcaggttttctcgagaacggctgggagggcatggtggatgggtggtatgggtttaggcaccaaaatgcacaagggaccggccaggccgccgattataagtctacgcaagccgccattgaccagatcactgggaagcttaataggttagtagagaagacaaataccgaattcgagagtattgagtcagaattctccgagatcgagcaccagataggcaacgtcattaattggacaaaggactctattaccgacatttggacgtatcaagccgaacttctggtggcaatggaaaatcagcacacaatcgacatggccgactcggagatgttgaacttatatgaaagggtgcgcaaacagctgcgccagaacgctgaagaagacggtaagggatgctttgagatctatcatgcctgcgatgattcctgtatggagtcgataagaaacaatacctatgaccatagccagtaccgggaagaagccctcctgaacagactgaatattaaccccgttaccttgtcctcaggatacaaggacattatcctgtggttttctttcggtgctagctgtttcgtgctgctcgccgtcgtaatggggttgtttttcttctgcctcaaaaacggtaacatgcgatgcaccatttgcatt

SEQ ID NO: 896 - DNA, 1683 bp, Influenza A virus
  misc_feature (1)..(1683): Codon Optimized Sequence Encoding H10 Hemagglutinin
atgtataagatcgtcgtcattatcgctctcctcggagccgtgaaaggtcttgacaaaatttgtctgggccatcacgcagtggccaatgggaccatcgtgaagacgctgacgaacgagaaagaagaggtgacaaacgctactgagacggtcgagagcaccggactcaataggttgtgcatgaaaggacgaaagcataaagatctgggcaactgtcaccccatcgggatgctgattggctccccagcctgcgacttacacctgactggcacctgggatacactgatcgagcgcgagaacgccattgcctactgttaccccggcgctacagtgaatggtgaggcccttcgccaaaagattatggagtcaggcggaatagataagatctctacaggcttcacttatgagagttcgattaactcggccgggacaactagggcgtgtatgcggaatggcgggaattccttctatgctgagcttaagtggttggtttccaagagcaaggggcagaattttcctcagaccaccaacacctatcgaaacacagacaccgctgaacacctcatcatgtggggcattcaccacccatcttcaacccaggagaagaacgacctctacggtactcaaagccttagtatcagcgtggggtcatctacctaccggaacaattttgtgcccgtggtgggagcgcgccctcaagtgaacggacaaagtggcaggatcgatttccattggactttggtccagcctggtgacaacatcacattcagtcacaacggtggcctgatcgcaccgtccagagtttccaaactgatcggccggggtctagggattcagagcgacgcccctattgataacaactgcgagtcaaaatgcttctggagggggggctccattaacactcgactgccctttcagaatctgtcaccccgaaccgtgggtcagtgtcctaagtacgtgaacaagagatcactcatgcttgccactgggatgcgcaatgtgcccgagctcatgcagggaagaggactgttcggagcgattgctgggtttctggaaaatgggtgggaagggatggtagatggatggtacggatttcgtcatcaaaacgcacagggcactggacaagcggcggactataagtcaactcaggctgccatagaccaaataaccgggaaactaaaccggctcgtcgagaagaccaacaccgaatttgaatctatcgagtcggaatttagcgagattgagcaccagataggaaatgttatcaattggaccaaggactccattacggatatttggacttaccaggcggagctgctggttgccatggagaatcagcacactattgacatggccgatagtgagatgttgaatttgtacgaaagagtgcgcaagcagctgaggcagaacgctgaagaggacggtaagggatgcttcgaaatttatcacgcatgcgatgattcctgcatggaatcgatcagaaacaatacatatgatcattctcaataccgggaggaggctttgctcaaccgcctgaatataaatcctgtgactctcagttcgggctataaagacatcatcctgtggttctcttttggcgcctcctgctttgtcctgctggcggtggtgatgggactcgtcttcttctgcctaaagaatggcaacatgcggtgtacaatctgtatt

SEQ ID NO: 897 - DNA, 47 bp, Artificial Sequence
  Synthetic: 5UTR-001, Upstream UTR
gggaaataagagagaaaagaagagtaagaagaaatataagagccacc

SEQ ID NO: 898 - DNA, 47 bp, Artificial Sequence
  Synthetic: 5UTR-002, Upstream UTR
gggagatcagagagaaaagaagagtaagaagaaatataagagccacc

SEQ ID NO: 899 - DNA, 145 bp, Artificial Sequence
  Synthetic: 5UTR-003, Upstream UTR
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 900 - RNA, 42 nt, Artificial Sequence
  Synthetic: 5UTR-004, Upstream UTR
gggagacaagcuuggcauuccgguacuguugguaaagccacc

SEQ ID NO: 901 - DNA, 47 bp, Artificial Sequence; identical to SEQ ID NO: 898
  Synthetic: 5UTR-005, Upstream UTR

SEQ ID NO: 902 - DNA, 145 bp, Artificial Sequence; identical to SEQ ID NO: 899
  Synthetic: 5UTR-006, Upstream UTR

SEQ ID NO: 903 - RNA, 42 nt, Artificial Sequence; identical to SEQ ID NO: 900
  Synthetic: 5UTR-007, Upstream UTR

SEQ ID NO: 904 - DNA, 47 bp, Artificial Sequence
  Synthetic: 5UTR-008, Upstream UTR
gggaattaacagagaaaagaagagtaagaagaaatataagagccacc

SEQ ID NO: 905 - DNA, 47 bp, Artificial Sequence
  Synthetic: 5UTR-009, Upstream UTR
gggaaattagacagaaaagaagagtaagaagaaatataagagccacc

SEQ ID NO: 906 - DNA, 47 bp, Artificial Sequence
  Synthetic: 5UTR-010, Upstream UTR
gggaaataagagagtaaagaacagtaagaagaaatataagagccacc

SEQ ID NO: 907 - DNA, 47 bp, Artificial Sequence
  Synthetic: 5UTR-011, Upstream UTR
gggaaaaaagagagaaaagaagactaagaagaaatataagagccacc

SEQ ID NO: 908 - DNA, 47 bp, Artificial Sequence
  Synthetic: 5UTR-012, Upstream UTR
gggaaataagagagaaaagaagagtaagaagatatataagagccacc

SEQ ID NO: 909 - DNA, 47 bp, Artificial Sequence
  Synthetic: 5UTR-013, Upstream UTR
gggaaataagagacaaaacaagagtaagaagaaatataagagccacc

SEQ ID NO: 910 - DNA, 47 bp, Artificial Sequence
  Synthetic: 5UTR-014, Upstream UTR
gggaaattagagagtaaagaacagtaagtagaattaaaagagccacc

SEQ ID NO: 911 - DNA, 47 bp, Artificial Sequence
  Synthetic: 5UTR-015, Upstream UTR
gggaaataagagagaatagaagagtaagaagaaatataagagccacc

SEQ ID NO: 912 - DNA, 47 bp, Artificial Sequence
  Synthetic: 5UTR-016, Upstream UTR
gggaaataagagagaaaagaagagtaagaagaaaattaagagccacc

SEQ ID NO: 913 - DNA, 47 bp, Artificial Sequence
  Synthetic: 5UTR-017, Upstream UTR
gggaaataagagagaaaagaagagtaagaagaaatttaagagccacc

SEQ ID NO: 914 - DNA, 371 bp, Artificial Sequence
  Synthetic: 3UTR-001, Creatine Kinase
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 915 - DNA, 568 bp, Artificial Sequence
  Synthetic: 3UTR-002, Myoglobin
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 916 - DNA, 289 bp, Artificial Sequence
  Synthetic: 3UTR-003, alpha-actin
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 917 - DNA, 379 bp, Artificial Sequence
  Synthetic: 3UTR-004, Albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 918 - DNA, 118 bp, Artificial Sequence
  Synthetic: 3UTR-005, alpha-globin
gctgccttctgcggggcttgccttctggccatgcccttcttctctcccttgcacctgtacctcttggtctttgaataaagcctgagtaggaaggcggccgctcgagcatgcatctaga

SEQ ID NO: 919 - DNA, 908 bp, Artificial Sequence
  Synthetic: 3UTR-006, G-CSF
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 920 - DNA, 835 bp, Artificial Sequence
  Synthetic: 3UTR-007, Col1a2; collagen, type I, alpha 2
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 921 - DNA, 297 bp, Artificial Sequence
  Synthetic: 3UTR-008, Col6a2; collagen, type VI, alpha 2
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 922 - DNA, 602 bp, Artificial Sequence
  Synthetic: 3UTR-009, RPN1; ribophorin I
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 923 - DNA, 785 bp, Artificial Sequence
  Synthetic: 3UTR-010, LRP1; low density lipoprotein receptor-related protein 1
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 924 - DNA, 3001 bp, Artificial Sequence
  Synthetic: 3UTR-011, Nnt1; cardiotrophin-like cytokine factor 1
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 925 - DNA, 1037 bp, Artificial Sequence
  Synthetic: 3UTR-012, Col6a1; collagen, type VI, alpha 1
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 926 - DNA, 577 bp, Artificial Sequence
  Synthetic: 3UTR-013, Calr; calreticulin
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 927 - DNA, 2212 bp, Artificial Sequence
  Synthetic: 3UTR-014, Col1a1; collagen, type I, alpha 1
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 928 - DNA, 729 bp, Artificial Sequence
  Synthetic: 3UTR-015, Plod1; procollagen-lysine, 2-oxoglutarate 5-dioxygenase 1
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 929 - DNA, 847 bp, Artificial Sequence
  Synthetic: 3UTR-016, Nucb1; nucleobindin 1
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 930 - DNA, 110 bp, Artificial Sequence
  Synthetic: 3UTR-017, alpha -globin
gctggagcctcggtggccatgcttcttgccccttgggcctccccccagcccctcctccccttcctgcacccgtacccccgtggtctttgaataaagtctgagtgggcggc

SEQ ID NO: 931 - protein, 565 aa, Influenza A virus
  misc_feature (1)..(565): H1N1-Wild type antigen encoded by NAV polynucleotides
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNNPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 932 - protein, 343 aa, Influenza A virus
  misc_feature (1)..(343): H1N1-Wild type antigen encoded by NAV polynucleotides
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNNPSIQSR

SEQ ID NO: 933 - protein, 185 aa, Influenza A virus
  misc_feature (1)..(185): H1N1-Wild type antigen encoded by NAV polynucleotides
GLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQ

SEQ ID NO: 934 - protein, 21 aa, Influenza A virus
  misc_feature (1)..(21): H1N1-Wild type antigen encoded by NAV polynucleotides
ILAIYSTVASSLVLLVSLGAI

SEQ ID NO: 935 - protein, 16 aa, Influenza A virus
  misc_feature (1)..(16): H1N1-Wild type antigen encoded by NAV polynucleotides
SFWMCSNGSLQCRICI

SEQ ID NO: 936 - protein, 565 aa, Influenza A virus
  misc_feature (1)..(565): H1N1-Wild type antigen encoded by NAV polynucleotides
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 937 - protein, 343 aa, Influenza A virus
  misc_feature (1)..(343): H1N1-Wild type antigen encoded by NAV polynucleotides
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSR

SEQ ID NO: 938 - protein, 185 aa, Influenza A virus
  misc_feature (1)..(185): H1N1-Wild type antigen encoded by NAV polynucleotides
GLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQ

SEQ ID NO: 939 - protein, 21 aa, Influenza A virus
  misc_feature (1)..(21): H1N1-Wild type antigen encoded by NAV polynucleotides
ILAIYSTVASSLVLLVSLGAI

SEQ ID NO: 940 - protein, 16 aa, Influenza A virus
  misc_feature (1)..(16): H1N1-Wild type antigen encoded by NAV polynucleotides
SFWMCSNGSLQCRICI

SEQ ID NO: 941 - protein, 561 aa, Influenza A virus
  misc_feature (1)..(561): H10N8-Wild type antigen encoded by NAV polynucleotides
MYKIVVIIALLGAVKGLDKICLGHHAVANGTIVKTLTNEQEEVTNATETVESTGINRLCMKGRKHKDLGNCHPIGMLIGTPACDLHLTGMWDTLIERENAIAYCYPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 942 - protein, 339 aa, Influenza A virus
  misc_feature (1)..(339): H10N8-Wild type antigen encoded by NAV polynucleotides
MYKIVVIIALLGAVKGLDKICLGHHAVANGTIVKTLTNEQEEVTNATETVESTGINRLCMKGRKHKDLGNCHPIGMLIGTPACDLHLTGMWDTLIERENAIAYCYPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQG

SEQ ID NO: 943 - protein, 188 aa, Influenza A virus
  misc_feature (1)..(188): H10N8-Wild type antigen encoded by NAV polynucleotides
RGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIIL

SEQ ID NO: 944 - protein, 21 aa, Influenza A virus
  misc_feature (1)..(21): H10N8-Wild type antigen encoded by NAV polynucleotides
WFSFGASCFVLLAVVMGLFFF

SEQ ID NO: 945 - protein, 13 aa, Influenza A virus
  misc_feature (1)..(13): H10N8-Wild type antigen encoded by NAV polynucleotides
CLKNGNMRCTICI

SEQ ID NO: 946 - protein, 560 aa, Influenza A virus; identical to SEQ ID NO: 56
  misc_feature (1)..(560): H7N9-Wild type antigen encoded by NAV polynucleotides

SEQ ID NO: 947 - protein, 338 aa, Influenza A virus
  misc_feature (1)..(338): H7N9-Wild type antigen encoded by NAV polynucleotides
MNTQILVFALIAIIPTNADKICLGHHAVSNGTKVNTLTERGVEVVNATETVERTNIPRICSKGKKTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGQSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKG

SEQ ID NO: 948 - protein, 188 aa, Influenza A virus
  misc_feature (1)..(188): H7N9-Wild type antigen encoded by NAV polynucleotides
RGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVIL

SEQ ID NO: 949 - protein, 21 aa, Influenza A virus
  misc_feature (1)..(21): H7N9-Wild type antigen encoded by NAV polynucleotides
WFSFGASCFILLAIVMGLVFI

SEQ ID NO: 950 - protein, 13 aa, Influenza A virus
  misc_feature (1)..(13): H7N9-Wild type antigen encoded by NAV polynucleotides
CVKNGNMRCTICI

SEQ ID NO: 951 - protein, 560 aa, Influenza A virus; identical to SEQ ID NO: 27
  misc_feature (1)..(560): H7N9-Wild type antigen encoded by NAV polynucleotides

SEQ ID NO: 952 - protein, 338 aa, Influenza A virus
  misc_feature (1)..(338): H7N9-Wild type antigen encoded by NAV polynucleotides
MNTQILVFALIAIIPTNADKICLGHHAVSNGTKVNTLTERGVEVVNATETVERTNIPRICSKGKMTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKG

SEQ ID NO: 953 - protein, 188 aa, Influenza A virus; identical to SEQ ID NO: 948
  misc_feature (1)..(188): H7N9-Wild type antigen encoded by NAV polynucleotides

SEQ ID NO: 954 - protein, 21 aa, Influenza A virus
  misc_feature (1)..(21): H7N9-Wild type antigen encoded by NAV polynucleotides
WFSFGASCFILLAIVMGLVFI

SEQ ID NO: 955 - protein, 13 aa, Influenza A virus
  misc_feature (1)..(13): H7N9-Wild type antigen encoded by NAV polynucleotides
CVKNGNMRCTICI

SEQ ID NO: 956 - protein, 683 aa, Artificial Sequence
  Synthetic: Engineered antigen encoded by NAV polynucleotides
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNNPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 957 - protein, 685 aa, Artificial Sequence
  Synthetic: Engineered antigen encoded by NAV polynucleotides
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPQRETRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 958 - protein, 338 aa, Artificial Sequence
  Synthetic: Engineered antigen encoded by NAV polynucleotides
MKANLLVLLCALAAADADTICIGYHANNSTDTVDTVLEKNVTVTHSVNLLEDSHNGKLCGGGGCNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 959 - protein, 338 aa, Artificial Sequence
  Synthetic: Engineered antigen encoded by NAV polynucleotides
MKANLLVLLCALAAADADTICIGYHANNSTDTVDTVLEKNVTVTHSVNLLEDSHNGKLCGGGGCNTKCQTPLGAIDSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRDGTYDYPKYSEESKLNREKVDGVKLESMGIYQILAIYSTVASSLVLLVSLGAISFWMCSNGSLQCRICI

SEQ ID NO: 960 - protein, 338 aa, Artificial Sequence
  Synthetic: Engineered antigen encoded by NAV polynucleotides
MKANLLVLLCALAAADADTICIGYHADDSTDTVDTVLEKDVTVTHSVNLLEDSHNGKLCGGGGCNTKCQTPLGAIDSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRDGTYDYPKYSEESKLNREKVDGVKLESMGIYQILAIYSTVASSLVLLVSLGAISFWMCSNGSLQCRICI

SEQ ID NO: 961 - protein, 458 aa, Artificial Sequence
  Synthetic: Engineered antigen encoded by NAV polynucleotides
MKANLLVLLCALAAADADTICIGYHANNSTDTVDTVLEKNVTVTHSVNLLEDSHNGKLCGGGGCNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKSGS

SEQ ID NO: 962 - protein, 1353 aa, Artificial Sequence
  Synthetic: MERS-CoV Spike Glucoprotein
MIHSVFLLMFLLTPTESYVDVGPDSIKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 963 - protein, 22 aa, Artificial Sequence
  Synthetic: 2A peptide
GSGATNFSLLKQAGDVEENPGP

SEQ ID NO: 964 - DNA, 66 bp, Artificial Sequence
  Synthetic: polynucleotide sequence encoding the 2A peptide
ggaagcggagctactaacttcagcctgctgaagcaggctggagacgtggaggagaaccctggacct

SEQ ID NO: 965 - RNA, 9 nt, Artificial Sequence
  Synthetic: consensus sequence of Kozak sequences
ccrccaugg

SEQ ID NO: 966 - DNA, 18 bp, Artificial Sequence
  Synthetic: Syn5 promoter
attgggcacccgtaaggg

SEQ ID NO: 967 - protein, 561 aa, Influenza A virus
  misc_feature (1)..(561): AHN97094 A/American green-winged teal/Ohio/13OS1869/2013 2013/09/08 HA 602704298
MYKIVLVLALLGAVHGLDKICLGHHAVPNGTIVKTLTNEKEEVTNATETVESKSLDKLCMKSRNYKDLGNCHPIGMIIGTPACDLHLTGTWDTLIERDNSIAYCYPGATVNEEALRQKIMESGGIDKISTGFTYGSSINSAGTTKACMRNGGNSFYAELKWLVSKNKGQNFPQTTNTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGASVDNDCESKCFWKGGSINTKLPFQNLSPRTVGQCPKYVNKRSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTVDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 968 - protein, 561 aa, Influenza A virus
  misc_feature (1)..(561): AHM24205 A/Eurasian coot/Germany/R411/2010 2010/02/ HA 594704736
MYKIVVIVTLLGAVRGLDKICLGHHAVANGTTVKTLTNEQEEVTNATETVESTSLNKLCMRGRSYKDLGRCHPIGILLGTPVCELHLTGAWDTLIERENAIAYCYPGATINEEALRQKIMESGGVSKISTGFTYGSSINPAGVTKACLRNGQSSFYAELRWLVSKTQGQNFPQTTNTYRNTDTAEHLIIWGIHHPSSTQEKNKLYGAQSLYISVGSSTYQNSFTPVVGARPQVNGQSGRIEFHWTLVQPGDNITFSHNGGLIAPSRVSKLTGRGLGIQSEASVDNNCESKCFWRGGSINTKLPFQNLSPRTVGQCPKYVNKRSLLLATGMRNVPEVMQGRGLFGAIAGFIENGWEGMVDGWYGFRHQNAQGTGQAADYKSTQAAIDQITGKLNRLIEKTNTEFESIESEFSNIEHQIGNVINWTKDSITDIWTYQAELLVAMENQHTIDMADSEMLNLYDRVRKQLRQNAEEDGKGCFEIYHTCDNSCMESIRNNTYDHSQYREEALLNRLNINPVKFSSGYKDIILWFSFGASCFVLLAVVLGLVFFCLKNGNMQCTVCI

SEQ ID NO: 969 - protein, 561 aa, Influenza A virus; identical to SEQ ID NO: 941
  misc_feature (1)..(561): AHK10761 A/Jiangxi/IPB13/2013 2013/12/04 HA 587680944

SEQ ID NO: 970 - protein, 561 aa, Influenza A virus
  misc_feature (1)..(561): AHK10763 A/Jiangxi/IPB13b/2013 2013/12/17 HA 587680948
MYKIVVIIALLGAVKGLDKICLGHHAVANGTIVKTLTNEQEEVTNATETVESTGINRLCMKGRKHKDLGNCHPIGMLIGTPACDLHLTGMWDTLIERENAIAYCYPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGAGPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 971 - protein, 561 aa, Influenza A virus
  misc_feature (1)..(561): AJD10539 A/chicken/Jiangxi/1204/2014 2014/01/05 HA 745629737
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTKLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 972 - protein, 561 aa, Influenza A virus
  misc_feature (1)..(561): AJD11559 A/chicken/Jiangxi/1232/2014 2014/01/05 HA 745631437
MYKVVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKNKGQNFPQTTNTYRNTDTAEHLIMWGIHHPSSIQEKNDLYGTQSLSISVGSSTYRNSFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 973 - protein, 561 aa, Influenza A virus
  misc_feature (1)..(561): AJD11571 A/chicken/Jiangxi/1270/2014 2014/01/05 HA 745631457
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATANVEALRQKIMESGGIDKISTGFTYGSSINSAGTTRACMRNGGNSFYAELKWLVSKSKGQNFPQTTNTYRNTDTAEHLIMWGIHHPSSIQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 974 - protein, 561 aa, Influenza A virus
  misc_feature (1)..(561): AJD11583 A/chicken/Jiangxi/1279/2014 2014/01/05 HA 745631477
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSVGTTRACMRNGGNSFYAELKWLVSKSKGQNFPQTTNTYRNTDTAEHLIMWGIHHPSSIQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 975 - protein, 561 aa, Influenza A virus
  misc_feature (1)..(561): AJD09903 A/chicken/Jiangxi/18399/2013 2013/08/04 HA 745628669
MYKIVVIIALLGAVKGLDKICLGHHAVANGTIVKTLTNEQEEVTNATETVESTGLNRLCMKGRKHKDLGNCHPIGMLIGTPACDLHLTGTWDTLIERENAIAYCYPGATVNEEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSRYREEALLNRLNINPVTLSSGYKDIILWFSFGASCFVLLAVVMGLVFFCLKNGNMRCTICI

SEQ ID NO: 976 - protein, 561 aa, Influenza A virus
  misc_feature (1)..(561): AJD09915 A/chicken/Jiangxi/18933/2013 2013/08/11 HA 745628689
MYKIVVIIALLGAVKGLDKICLGHHAVANGTIVKTLTNEQEEVTNATETVESTGLNRLCMKGRKHKDLGNCHPIGMLIGTPACDLHLTGTWDTLIERENAIAYCYPGATVNEEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 977 - protein, 561 aa, Influenza A virus
  misc_feature (1)..(561): AJD09927 A/chicken/Jiangxi/19924/2013 2013/08/25 HA 745628709
MYKIVVIIALLGAVKGLDKICLGHHAVANGTIVKTLTNEQEEVTNATETVESTGLNRLCMKGRKHKDLGNCHPIGMLIGTPACDLHLTGTWDTLIERENAIAYCYPGATVNEEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 978 - protein, 561 aa, Influenza A virus
  misc_feature (1)..(561): AJD09939 A/chicken/Jiangxi/19960/2013 2013/08/25 HA 745628729
MYKIVVIIALLGAVKGLDKICLGHHAVANGTIVKTLTNEQEEVTNATETVESTGLNRLCMKGRKHKDLGNCHPIGMLIGTPACDLHLTGTWDTLIERENAIAYCYPGATVNEEALRQKIMESGGIDKISTGFTYGSSINSAGTTSACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFLENGWEGMVDGWYGFRHQNAQGTGQAADYKSTQAAIDQITGKLNRLVEKTNTEFESIESEFSEIEHQIGNVINWTKDSIIDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 979 - protein, 561 aa, Influenza A virus
  misc_feature (1)..(561): AJD10551 A/chicken/Jiangxi/23252/2013 2013/10/13 HA 745629757
MYKIVVIIALLGAVKGLDKICLGHHAVANGTIVKTLTNEKEEVTNATETVESTGLNRLCMKGRKHKDLGNCHPIGMLIGSPACDLHLTGTWDTLIERENAIAYCYPGATVNGEALRQKIMESGGIDKISTGFTYESSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 980 - protein, 561 aa, Influenza A virus
  misc_feature (1)..(561): AJD10563 A/chicken/Jiangxi/23259/2013 2013/10/13 HA 745629777
MYKIVVIIALLGAVKGLDKICLGHHAVANGTIVKTLTNEQEKVTNATETVESTGLNRLCMKGRKHKDLGNCHPIGMLIGTPACDLHLTGTWDTIIERENAIAYCYPGATVNEEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 981 - protein, 561 aa, Influenza A virus
  misc_feature (1)..(561): AJD10575 A/chicken/Jiangxi/23274/2013 2013/10/13 HA 745629797
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 982 - protein, 561 aa, Influenza A virus
  misc_feature (1)..(561): AJD10587 A/chicken/Jiangxi/27600/2013 2013/11/24 HA 745629817
MYKIIVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 983 - protein, 561 aa, Influenza A virus
  misc_feature (1)..(561): AJD10611 A/chicken/Jiangxi/28113/2013 2013/11/03 HA 745629857
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDNSCMESIRNNTYDHSQYREEALLNRLNINPVTLSSGYKDIILWFSFGASCFVLLAVVMGLFFFCLKNGNMRCTICI

SEQ ID NO: 984 - protein, 561 aa, Influenza A virus
  misc_feature (1)..(561): AJD11595 A/chicken/Jiangxi/3152/2014 2014/01/12 HA 745631497
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSIQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 985 - protein, 561 aa, Influenza A virus
  misc_feature (1)..(561): AJD10683 A/chicken/Jiangxi/34609/2013 2013/12/23 HA 745629977
MYKIVVIIALLGAVKGLDKICLGHHAVANGTIVKTLTNEQEEVTNATETVESTGINRLCMKGRKHKDLGNCHPIGMLIGTPACDLHLTGTWDTLIERENASAYCYPGATVNVEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTICI

SEQ ID NO: 986 - protein, 561 aa, Influenza A virus
  misc_feature (1)..(561): AJD11271 A/chicken/Jiangxi/36229/2013 2013/12/29 HA 745630957
MYKVVVIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKNKGQNFPQTTNTYRNTDTAEHLIMWGIHHPSSIQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 987 - protein, 555 aa, Influenza A virus
  misc_feature (1)..(555): AIK26172 A/chicken/Jiangxi/JXA132717/2014 2014/01/01 HA 673245754
VIIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTKLPFQNLSPRTVGQCPKYVNRKSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCTIC

SEQ ID NO: 988 - protein, 561 aa, Influenza A virus
  misc_feature (1)..(561): AFJ19053 A/duck/Guangdong/E1/2012 2012/01/10 HA 386656047
MYKIVVIIALLRAVKGLDKICLGHHAVANGTIVKTLTNEQEEVTNATETVESTSLNRLCMKGRNHKDLGNCHPIGMLIGTPTCDLHLTGTWDTLIERENAVAYCYPGATVNEEALRQRIMESGGINKISTGFTYGSSINSAGTTKACMRNGGNSFYAELKWLVSKSKGQNFPQTMNTYRNTDTVEHLIMWGIHHPSSIQEKNDLYGTQSLSISVGSSTYQNNFVPVVGARPQVNGQSGRIDFHWTLVQPGDNITFSHNGGLIAPSRVSKLVGRGLGIQSDAPIDNNCESKCFWRGGSINTKLPFQNLSPRTVGQCPKYVNKKSLMLATGMRNVPEIVQERGLFGAIAGFIENGWEGMVDGWYGFRHQNAQGTGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAIVMGLVFFCLKNGNMRCTICI

SEQ ID NO: 989 - protein, 161 aa, Influenza A virus
  misc_feature (1)..(161): BAG16719 A/duck/Hokkaido/W95/2006 2006// HA 172052510
TEFESIESEFSEIEHQIGNVINWTKDSITDIWTYQAELLVAMENQHTIDMADSEMLNLYERVRKQLRQNAEEDGKGCFEIYHACDDSCMESIRNNTYDHSHYREEALLNRLNINPVKLSSGYKDIILWFSFGASCFVLLAVVMGLVFFCLKNGNMRCTICI

SEQ ID NO: 990 - protein, 561 aa, Influenza A virus
  misc_feature (1)..(561): AJD14343 A/duck/Jiangxi/2039/2005 2005/02/04 HA 745636111
MYKIVVIIALLGAVKGLDKICLGHHAVANGTIVKTLTNEQEEVTNATETVESTSLNRLCMKGRSHKDLGNCHPIGMLIGTPACDLHLTGTWDTLIERENAIAYCYPGATVNEEALRQKIMESGGISKISTGFTYGSSINSAGTTKACMRNGGNSFYAELKWLVSKNKGQNFPQTTNTYRNTDTAEHLIMWGIHHPSSTQEKNDLYGTQSLSISVGSSTYQNNFVPVVGARPQVNGQSGRIDFHWTLIQPGDNITFSHNGGLIAPSRVSKLVGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 991 - protein, 561 aa, Influenza A virus
  misc_feature (1)..(561): AJD14367 A/duck/Jiangxi/22960/2008 2008/12/15 HA 745636151
MYKIVVIIALLGAVKGLDKICLGHHAVANGTIVKTLTNEQEEVTNATETVESASLNRLCMKGRRHKDLGNCHPIGMLIGTPACDLHLTGTWDTLIERENAIAYCYPGATVNEEALRQKVMESGGISKISTGFTYGSSINSAGTTRACMRNGGNSFYAELKWLVSKNKGQNFPQTTNTYRNTDTAEHLIIWGIHHPSSTQEKNDLYGTQSLSISVGSSTYQNNFVPVVGARPQVNGQSGRIDFHWTLVQPGDNITFSHNGGLIAPSRVSKLVGRGLGIQSDATIDNNCESKCFWRGGSINTRLPFQNLSPRTVGQCPKYVNKRSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 992 - protein, 561 aa, Influenza A virus
  misc_feature (1)..(561): AJD14379 A/duck/Jiangxi/4759/2009 2009/03/15 HA 745636171
MYKIVVIIALLGAVKGLDKICLGHHAVANGTIIKTLTNEQEEVTNATETVESASLNRLCMKGRRHKDLGNCHPIGMLIGTPACDLHLTGTWDTLIERENAIAYCYPGATVNEEALRQKVMESGGISKISTGFTYGSSINSAGTTKACMRNGGNSFYAELKWLVSKSKGQNFPQTTNTYRNTDTAEHLIIWGIHHPSSTQEKNDLYGTQSLSISVGSSTYQNNFVPVVGARPQVNGQSGRIDFHWTLVQPGDNITFSHNGGLIAPSRVSKLVGRGLGIQSDAPIDNNCESKCFWRGGSINTRLPFQNLSPRTVGQCPKYVNKRSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 993 - protein, 561 aa, Influenza A virus
  misc_feature (1)..(561): AJD10887 A/duck/Jiangxi/6450/2013 2013/02/03 HA 745630317
MYKIVVIIALLGAVKGLDKICLGHHAVANGTIVKTLTNEQEEVTNATETVESTGLNRLCMKGRNHKDLGNCHPIGMLIGTPACDLHLTGTWDTLIERENAIAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 994 - protein, 561 aa, Influenza A virus
  misc_feature (1)..(561): AJD10911 A/duck/Jiangxi/6474/2013 2013/02/03 HA 745630357
MYKIVVIIALLGAVKGLDKICLGHHAVANGTIVKTLTNEQEEVTNATETVESTGLNRLCMKGRNHKDLGNCHPIGMLIGTPACDLHLTGTWDTLIERENATAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 995 - protein, 561 aa, Influenza A virus
  misc_feature (1)..(561): AJD10923 A/duck/Jiangxi/6487/2013 2013/02/03 HA 745630377
MYKIVVIIALLGAVKGIDKICLGHHAVANGTIVKTLTNEQEEVTNATETVESTGLNRLCMKGRNHKDLGNCHPIGMLIGTPACDLHLTGTWDTLIERENAIAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 996 - protein, 561 aa, Influenza A virus
  misc_feature (1)..(561): AJD10971 A/duck/Jiangxi/6526/2013 2013/02/03 HA 745630457
MYKIVVIIALLGAVKGLDKICLGHHAVANGTIVKTLTNEQEEVTNATETVESTGLNRLCMKGRNHKDLGNCHPIGMLIGTPACDLHLTGTWDTLIERENAIAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSYAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 997 - protein, 561 aa, Influenza A virus
  misc_feature (1)..(561): AJD10995 A/duck/Jiangxi/6544/2013 2013/02/03 HA 745630497
MYKIVVIIALLGAVKGLDKICLGHHAVVNGTIVKTLTNEQEEVTNATETVESTGLNRLCMKGRNHKDLGNCHPIGMLIGTPACDLHLTGTWDTLIERENAIAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 998 - protein, 561 aa, Influenza A virus
  misc_feature (1)..(561): AJD11055 A/duck/Jiangxi/6602/2013 2013/02/03 HA 745630597
MYKIVVIIALLGAVKGLDKICLGHHAVANGTIVKTLTNEQEEVTNATETVESTGLNRLCMKGRNHKDLGNCHPIGMLIGTPACDLHLTGTWDTLIERENATAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDTPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 999 - protein, 561 aa, Influenza A virus
  misc_feature (1)..(561): AJD11091 A/duck/Jiangxi/6645/2013 2013/02/03 HA 745630657
  misc_feature (49)..(49): Xaa can be any naturally occurring amino acid
MYKIVVIIALLGAVKGLDKICLGHHAVANGTIVKTLTNEQEEVTNATEXVESTGLNRLCMKGRNHKDLGNCHPIGMLIGTPACDLHLTGTWDTLIERENAIAYCYPGATVNEEALRQKIMESGGINKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1000 - protein, 555 aa, Influenza A virus
  misc_feature (1)..(555): AIK26225 A/duck/Jiangxi/JXA132712/2014 2014/01/01 HA 673245880
IIALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNRRSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTMDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1001 - protein, 551 aa, Influenza A virus
  misc_feature (1)..(551): AIK26196 A/duck/Jiangxi/JXA132727/2014 2014/01/01 HA 673245811
IALLGAVKGLDKICLGHHAVANGTIVKTLTNEQEEVTNATETVESTGINRLCMKGRKHKDLGNCHPIGMLIGTPACDLHLTGTWDTLIERENAIAYCYPGATVNVEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYRNNFVPVVGARPQVNGQSGRIDFHWTLVQPGDNITFSHNGGLIAPSRVSKLIGRGLGIQSDAPIDNNCESKCFWRGGSINTKLPFQNLSPRTVGQCPKYVNRKSLMLATGMRNVPELIQGRGLFGAIAGFLENGWEGMVDGWYGFRHQNAQGTGQAADYKSTQAAIDQITGKLNRLVEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLFFFCLKNGNMRCT

SEQ ID NO: 1002 - protein, 561 aa, Influenza A virus
  misc_feature (1)..(561): ABO52082 A/longtail duck/Maryland/295/2005 2005/12/05 HA 134046947
MYKIVLVLALLGAVHGLDKICLGHHAVPNGTIVKTLTNEKEEVTNATETVESKSLDKLCMKNRNYKDLGNCHPIGMVVGTPACDLHLTGTWDTLIERDNSIAYCYPGATVSEEALRQKIMESGGIDKISTGFTYGSSINSAGTTKACMRNGGNSFYSELKWLVSKNKGQNFPQTTNTYRNTDSVEHLIIWGIHHPSSTQEKNDLYGTQSLSISVGSSTYQNNFVPVVGARPQVNGQSGRIDFHWTMVQPGDNITFSHNGGLIAPNRVSKLKGRGLGIQSGASVDNDCESKCFWKGGSINTKLPFQNLSPRTVGQCPKYVNKKSLLLATGMRNVPEVAQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 1003 - protein, 561 aa, Influenza A virus
  misc_feature (1)..(561): ADU16029 A/mallard/Interior Alaska/6MP0758/2006 2006/08/08 HA 315421084
MYKIVLVLALFGAVHGLDKICLGHHAVPNGTIVKTLTNEKEEVTNATETVESKSLDKLCMKSRNYKDLGNCHPIGMVIGTPACDLHLTGTWDTLIERDNSIAYCYPGATVNEEALRQKIMESGGIDKISTGFTYGSSINSAGTTKACMRNGGNSFYAELKWLVSKNKGQNFPQTTNTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGVSVDNDCESKCFWKGGSINTKLPFQNLSPRTVGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 1004 - protein, 379 aa, Influenza A virus
  misc_feature (1)..(379): AER09406 A/mallard/Korea/1041/2010 2010/11/ HA 353525333
TSEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDALIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLDIHPVTLSSGYKDIILWFSFGASCFVLLAVVMGLVFFCLKNGNMQCTICI

SEQ ID NO: 1005 - protein, 561 aa, Influenza A virus
  misc_feature (1)..(561): AER09416 A/mallard/Korea/1203/2010 2010/12/ HA 353525351
MYKIVVIIALLGTVKGLDKICLGHHAVANGTIVKTLTNEQEEVTNATETVESKSLNRLCMKGRNHKDLGNCHPIGMLIGTPACDLHLTGTWDTLIERENAIAYCYPGATINEEALRQKIMESGGISKISTGFTYGSSINSAGTTKACMRNGGNSFYAELKWLVSKSKGQNFPQTTNTYRNTDTSEHLIMWGIHHPYSTQEKNDLYGTQSLSISVGSSTYQNNFVPVVGARPQVNGQSGRIDFHWTLVQPGDNITFSHNGGLIAPSRVSKLIGRGLGIQSDASIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1006 - protein, 561 aa, Influenza A virus
  misc_feature (1)..(561): AHZ38995 A/mallard/Sweden/233/2002 2002/10/25 HA 632805884
MYKVVVIIALLGAVRGLDKICLGHHAVANGTIVKTLTNEQEEVTNATETVESKSLGKLCMKGRSYNDLGNCHPIGILIGTPACDLHLTGTWDTLIERENAVAYCYPGATVNEEALRQKIMESGGISKISTGFTYGTSINSAGTTKACMRNGGNSFYAELKWLVSKNKGQNFPQTTNTYRNTDTAEHLIIWGIHHPSSTQEKNDLYGTQSLSISVGSSTYQNNFVPVVGARPQVNGQSGRIDFHWTLLQPGDNITFSHNGGLIAPSRVSKLIGRGLGIQSEAPIDNGCESKCFWKGGSINTKLPFQNLSPRTVGQCPKYVNKRSLMLATGMRNVPEIMHGRGLFGAIAGFIENGWEGMVDGWYGFRHQNAQGTGQAADYKSTQAAIDQITGKLNRLIEKTNTEFESIESEFSEIEHQIGNIINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCLILLAVVMGLVFFCLKNGNMRCTICI

SEQ ID NO: 1007 - protein, 561 aa, Influenza A virus
  misc_feature (1)..(561): ADE75294 A/mallard/Sweden/7/2003 2003/05/24 HA 294441777
MYKIVVIIALIGAVKGLDKICLGHHAVANGTVVKTLTNEHEEVTNATETVENTSLNKLCMKGRSHKDLGNCHPIGMLIGTPVCDLHLTGTWDTLIERENAIAYCYPGATVNEEALRQKIMESGGINKISTGFTYGSSINSAGTTKACMRNGGNSFYAELKWLVSKSKGQNFPQTTNIYRNTDTAEHLVMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNDCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 1008 - protein, 561 aa, Influenza A virus
  misc_feature (1)..(561): AJD14391 A/migratory duck/Jiangxi/21248/2009 2009/10/28 HA 745636191
MYKIVVIIALLGAVKGLDKICLGHHAVANGTIVKTLTNEQEEVTNATETVESTSLNRLCMKGRNHKDLGNCHPIGMLIGTPACDLHLTGTWDTLIERENAIAYCYPGATINEEALRQKIMESGGISKISTGFTYGSSINSAGTTKACMRNGGNSFYAELKWLVSKNKGQNFPQTTNTYRNTDTAEHLIMWGIHHPSSTQEKNDLYGTQSLSISIGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1009 - protein, 561 aa, Influenza A virus
  misc_feature (1)..(561): AJD14355 A/migratory duck/Jiangxi/593/2005 2005/01/09 HA 745636131
MYKIVVIIALLGAVKGLDKICLGHHAVANGTIVKTLTNEQEEVTNATETVESTSLNRLCMKGRSHKDLGNCHPIGMLIGTPACDLHLTGTWDTLIERENAIAYCYPGATVNEEALRQKIMESGGISKISTGFTYGSSINSAGTTKACMRNGGNSFYAELKWLVSKNKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLVGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVKLSSGYKDIILWFSFGASCFVLLAVVMGLVFFCLKNGNMRCTICI

SEQ ID NO: 1010 - protein, 561 aa, Influenza A virus
  misc_feature (1)..(561): ACK43693 A/northern pintail/California/44221-656/2006 2006/09/10 HA 217385610
MYKIVLVLALLGAVHGLDKICLGHHAVSNGTIVKTLTNEKEEVTNATETVESKSLDKLCMKSRNYKDLGNCHPIGMVIGTPACDLHLTGTWDTLIERDNSIAYCYPGATVNEEALRQKIMESGGIDKISTGFTYGSSINSAGTTKACMRNGGNSFYAELKWLVSKTKGQNFPQTTNTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGASVDNDCESKCFWKGGSINTKLPFQNLSPRTVGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHAQYREEALLNRLNINPVKLSSGYKDVILWFSFGASCFVLLAVIMGLVFFCLKNGNMRCTICI

SEQ ID NO: 1011 - protein, 561 aa, Influenza A virus
  misc_feature (1)..(561): AEK49546 A/northern shoveler/California/9235/2008 2008/11/22 HA 340540124
MYKIVPVLALLGAVHGLDKICLGHHAVPNGTIVKTLTNEKEEVTNATETVESGSLDKLCMKSRNYKDLGNCHPIGMVIGTPACDLHLTGTWDTLIERDNSIAYCYPGATVNEEALRQKIMESGGIDKIGTGFTYEPSINSAGDTKACMRNGRNSFYAELKWLVSKTKGQNFPQTTNTYRNTDSAEHLIIWGIHHPSSTKEKNDLYGTQSLSISVGSSTYQNNFVPVVGARPQVNGQSGRIDFHWTMVQPGDNITFSHNGGLIAPSRVSKLKGRGLGIQSEASIDNDCESKCFWKGGSINTKLPFQNLSPRTVGQCPKYVNKRSLLLATGMRNVPEVVQGRGLFGAIAGFIENGWEGMVDGWYGFRHQNAQGTGQAADYKSTQAAVDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDSCMESIRNNTYDHAQYREEALLNRLNINPVKLSSGYKDVILWFSFGASCFVLLAVIMGLVFFCLKNGNMRCTICI

SEQ ID NO: 1012 - protein, 310 aa, Influenza A virus
  misc_feature (1)..(310): ACZ48518 A/quail/Italy/1117/1965 1965// HA 269826127
AVANGTTVKTLTNEQEEVTNATETVESTSLNKLCMKGRRYKDLGNCHPIGMLIGTPVCDLHLTGTWDTLIERENATAYCYPGVTINEEALRQKIMESGGISKMRTGFTYGPSINSAGTTRSCMRNGGNSFYAELKWLVSGTKGQNFPQTTNTYRNTDTAEHLIIWGIHHPSSTQEKNDLYGTQSLSISVGSSTYQNNFVPVIGARPQVNGQSGRIEFHWTLVRPGDNITFSHNGGLIAPDRVSKLIGKGIGIQSGAVIDKDCESKCFWRGGSIITELPFQNLSPRTVGQCPKYVKKRSLLLATGMRNVPE

SEQ ID NO: 1013 - protein, 561 aa, Influenza A virus
  misc_feature (1)..(561): ABI84499 A/quail/Italy/1117/1965 1965// HA 115278204
MYKVVVIIALLGAVRGLDKICLGHHAVANGTTVKTLTNEQEEVTNATETVESTSLNKLCMKGRRYKDLGNCHPIGMLIGTPVCDLHLTGTWDTLIERENATAYCYPGVTINEEALRQKIMESGGISKMRTGFTYGPSINSAGTTRSCMRNGGNSFYAELKWLVSGTKGQNFPQTTNTYRNTDTAEHLIIWGIHHPSSTQEKNDLYGTQSLSISVGSSTYQNNFVPVIGARPQVNGQSGRIEFHWTLVRPGDNITFSHNGGLIAPDRVSKLIGKGIGIQSGAVIDKDCESKCFWRGGSIITELPFQNLSPRTVGQCPKYVKKRSLLLATGMRNVPEVVQGRGLFGAIAGFIENGWEGMVDGWYGFRHQNAQGIGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHTCDNSCMESIRNNTYDHSQYREEALLNRLNINPVKLSSGYKDIILWFSFGASCFVLLAVIMGLGFFCLKNGNMRCTICI

SEQ ID NO: 1014 - protein, 561 aa, Influenza A virus
  misc_feature (1)..(561): AEA04419 A/quail/Italy/1117/1965 1965/06/11 HA 326698679
MYKVVVIIALLGAVRGLDKICLGHHAVANGTTVKTLTNEQEEVTNATETVESTSLNKLCMKGRRYKDLGNCHPIGMLIGTPVCDLHLTGTWDTLIERENATAYCYPGVTINEEALRQKIMESGGISKMRTGFTYGPSINSAGTTRSCMRNGGNSFYAELKWLVSGTKGQNFPQTTNTYRNTDTAEHLIIWGIHHPSSTQEKNDLYGTQSLSISVGSSTYQNNFVPVIGARPQVNGQSGRIEFHWTLVRPGDNITFSHNGGLIAPDRVSKLIGKGIGIQSGAVIDKDCESKCFWRGGSIITELPFQNLSPRTVGQCPKYVKKRSLLLATGMRNVPEVVQGRGLFGAKAGFIENGWEGMVDGWYGFRHQNAQGIGQAADYKSTQTAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHTCDNSCMESIRNNTYDHSQYREEALLNRLNINPVKLSSGYKDIILWFSFGASCFVLLAVIMGLGFFCLKNGNMRCTICI

SEQ ID NO: 1015 - protein, 561 aa, Influenza A virus
  misc_feature (1)..(561): AGU01953 A/ruddy shelduck/Mongolia/1602/2010 2010/09/11 HA 532807795
MDKKVVVIALLGAVKGLDKICLGHHAVANGTIVKTLTNEQEEVTNATETVESTSLNRLCMKGRNHKDLGNCHPIGMLIGTPACDLHLTGTWDTLIERENAIAYCYPGATVNEEALRQKIMESGGISKTNTGFTYGSSINSAGTTKACMRNGGNSFYAELKWLVSKNKGQNFPQTTNTYRNTDTAEHLIMWGIHHPSSTQEKNDLYGTQSLSISVGSSTYQSNFVPVVGARPQVNGQSGRIDFHWTLVQPGDNITFSHNGGLIAPNRVSKLIGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSDIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1016 - protein, 561 aa, Influenza A virus
  misc_feature (1)..(561): AGL58508 A/ruddy turnstone/New Jersey/1148668/2004 2004/05/17 HA 498917574
MYKIVLVLALLGAVHGLDKICLGHHAVPNGTIVKTLTNEKEEVTNATETVESKSLDKLCMKSRNYKDLGNCHPIGMVIGTPACDLHLTGTWDTLIERDNSIAYCYPGATVNEEALRQKIMESGGIDKISTGFTYGSSINSAGTTRSCMRSGGNSFYAELKWLVSKNKGQNFPQTANTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGASVDNDCESKCFWKGGSINTKLPFQNLSPRTVGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINPVKLSSGYKDVILWFSFGASCFVLLAVIMGLVFFCLKNGNMRCTICI

SEQ ID NO: 1017 - protein, 561 aa, Influenza A virus
  misc_feature (1)..(561): AGG28633 A/shorebird/Delaware Bay/379/2008 2008/05/17 HA 454506743
MYKIVLVLALLGAVHGLDKICLGHHAVSNGTIVKTLTNEKEEVTNATETVESKNLDRLCMKNRNYKDLGSCHPIGMVIGTPACDLHLTGTWDTLIERDNSIAYCYPGATVNEEALRQKIMESGGIDKISTGFTYGSSINSAGTTRACMRNGGNSFYAELKWLVSKSKGQNFPQTTNTYRNTDSAEHLIIWGIHHPSSTQEKNDLYGTQSLSISVGSSTYQNNFVPVVGARPQVNGQSGRIDFHWTMVQPGDNITFSHNGGLIAPSRVSKLKGRGLGIQSGASVDNDCESKCFWKGGSIKTKLPFQNLSPRTVGQCPKYVNKKSLLLATGMRNVPEVVQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHKCDDNCMESIRNNTYDHTQYREEALLNRLNINSVKLSSGYKDVILWFSFGASCFVLLAVIMGLVFFCLKNGNMRCTICI

SEQ ID NO: 1018 - protein, 561 aa, Influenza A virus
  misc_feature (1)..(561): AGU01957 A/surf scoter/Mongolia/878V/2009 2009/09/15 HA 532807803
MYKIVVVIALLGAVKGLDKICLGHHAVANGTIVKTLTNEQEEVTNATETVESTSLNRLCMKGRNHKDLGNCHPIGMLIGTPACDLHLTGTWDTLIERENAIAYCYPGATINEEALRQKIMESGGISKISTGFTYGSSINSAGTTKACMRNGGNGFYAELKWLVSKNKGQNFPQTTNTYRNTDTAEHLIMWGIHHPSSTQEKNDLYGTQSLSISVGSSTYQNNFVPIVGARPQVNGQSGRIDFHWTLVQPGDNITFSHNGGLMAPNRVSKLIGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYEHSQYREEALLNRLNINPVTLSSGYKDIILWFSFGASCFVLLAVVMGLVFFCLKNGNMRCTILI

SEQ ID NO: 1019 - protein, 561 aa, Influenza A virus
  misc_feature (1)..(561): AGU01970 A/velvet scoter/Mongolia/879V/2009 2009/09/15 HA 532807843
MYKIVVVIALLGAVKGLDKICLGHHAVANGTIVKTLTNEQEEVTNATETVESTSLNRLCMKGRNHKDLGNCHPIGMLIGTPACDLHLTGTWDTLIERENAIAYCYPGATINEEALRQKIMESGGISKISTGFTYGSSINSAGTTKACMRNGGNGFYAELKWLVSKNKGQNFPQTTNTYRNTDTAEHLIMWGIHHPSSTQEKNDLYGTQSLSISVGSSTYQNNFVPIVGARPQVNGQSGRIDFHWTLVQPGDNITFSHNGGLMAPNRVSKLIGRGLGIQSDAPIDNNCESKCFWRGGSINTRLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYEHSQYREEALLNRLNINPVTLSSGYKDIILWFSFGASCFVLLAVAMGLVFFCLKNGNMRCTICI

SEQ ID NO: 1020 - protein, 561 aa, Artificial Sequence
  Synthetic Polypeptide
MNTQILVFALIAIIPTNADKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 1021 - protein, 561 aa, Artificial Sequence
  Synthetic Polypeptide
MYKIVVIIALLGAVKGLDKICLGHHAVANGTIVKTLTNEQEEVTNATETVESTGLNRLCMKGRKHKDLGNCHPIGMLIGTPACDLHLTGTWDTLIERENAIAYCYPGATVNEEALRQKIMESGGIDKISTGFTYGSSINSAGTTRACMRNGGNSFYAELKWLVSKSKGQNFPQTTNTYRNTDTAEHLIMWGIHHPSSTQEKNDLYGTQSLSISVGSSTYQNNFVPVVGARPQVNGQSGRIDFHWTLVQPGDNITFSHNGGLIAPSRVSKLIGRGLGIQSDAPIDNNCESKCFWRGGSINTRLPFQNLSPRTVGQCPKYVNKRSLMLATGMRNVPELMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHACDDSCMESIRNNTYDHSQYREEALLNRLNINPVTLSSGYKDIILWFSFGASCFVLLAVVMGLVFFCLKNGNMRCTICI

SEQ ID NO: 1022 - protein, 567 aa, Influenza A virus
SKSRGYKMNTQILVFALMAIIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGATSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSGVQVDANCEGDCYHSGGTIISNLPFQNINSRAVGKCPRYVKQESLLLATGMKNVPEIPKGRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAMQNRIQIDPVKLSSGYKDVILWFSFGASCFILLAIAMGLVFICVKNGNMRCTICI

SEQ ID NO: 1023 - protein, 560 aa, Influenza A virus; identical to SEQ ID NO: 53

SEQ ID NO: 1024 - DNA, 1644 bp, Influenza A virus
atcatcccaacgaacgcggacaaaatctgcctcggacatcatgccgtttccaacgggacgaaagtgaacactctgactgagaggggcgtcgaggtggtcaatgctaccgaaaccgtggaacgcaccaatgtgcctcggatttgctcaaagggaaagaggactgtggatctcggacaatgcggattgctgggaaccatcactggaccgccgcagtgcgaccagttcctcgaattctccgccgaccttatcatcgaacggcgcgaaggatcagacgtttgctaccctggaaagttcgtgaacgaagaggctctgagacagatcctgcgagagtcggggggtatcgacaaggaaaccatggggttcacctactccggtatccgtactaacggcgcaacttcagcgtgtcggagatctgggtcatctttctacgctgagatgaaatggcttctgtcaaacaccgataacgccgccttcccacaaatgaccaagtcctacaagaacaccagaaaggatccggcattgattatctgggggatccaccactcgggaagcaccactgagcaaaccaaactgtacggaagcggaaacaagctgatcaccgtcggctccagcaattaccagcagtcatttgtcccatcgccgggcgcaagaccccaagtcaacggccagtccggccgcatcgacttccactggctgatcctgaacccgaatgacactgtgaccttctcgttcaacggagcctttatcgcaccggatagagcgagcttcctgcgcggaaaatcgatgggaatccagtccggggtccaagtggatgcgaactgcgaaggagactgctaccattccggcggaactatcatttcgaatttgcctttccaaaacatcaattcccgggccgtgggaaagtgtccccgctatgtgaaacaggaatcgctgctcctcgccactgggatgaaaaatgtgccagaaataccgaagggacgcggcctgtttggagccattgcgggcttcattgaaaatggatgggagggcctcattgatggttggtacggctttcggcaccaaaacgcccagggagaaggaaccgcggcggactacaaaagcactcagagcgccatcgatcagatcacgggaaagctgaaccgcctgatcgaaaagaccaaccagcaattcgagctgatcgataacgagttcaccgaagtggaaaagcagattggcaacgtgatcaactggacccgggacagcatgacggaggtctggagctacaatgcagaactcctggtggcgatggagaaccagcacactatcgaccttgctgactcggagatgaacaagctgtatgaacgggtcaaacgccaactcagggagaacgcagaagaagatggaactggttgtttcgagatcttccataagtgcgacgacgattgcatggcctcgatccgcaacaatacttacgaccactccaagtaccgggaggaggctatgcagaatcggatccagatcgacccggtcaagctcagctcaggatacaaggatgtgatcctgtggttctcgttcggcgcctcgtgctttatccttctggctatcgccatgggtttggtgtttatctgcgtgaagaatgggaatatgagatgtactatttgcatc

SEQ ID NO: 1025 - RNA, 1870 nt, Influenza A virus
gggaaauaagagagaaaagaagaguaagaagaaauauaagagccaccaugucaaagucccgcgguuacaagaugaacacccagauccucguguuugcacucauggccaucaucccaacgaacgcggacaaaaucugccucggacaucaugccguuuccaacgggacgaaagugaacacucugacugagaggggcgucgagguggucaaugcuaccgaaaccguggaacgcaccaaugugccucggauuugcucaaagggaaagaggacuguggaucucggacaaugcggauugcugggaaccaucacuggaccgccgcagugcgaccaguuccucgaauucuccgccgaccuuaucaucgaacggcgcgaaggaucagacguuugcuacccuggaaaguucgugaacgaagaggcucugagacagauccugcgagagucgggggguaucgacaaggaaaccaugggguucaccuacuccgguauccguacuaacggcgcaacuucagcgugucggagaucugggucaucuuucuacgcugagaugaaauggcuucugucaaacaccgauaacgccgccuucccacaaaugaccaaguccuacaagaacaccagaaaggauccggcauugauuaucugggggauccaccacucgggaagcaccacugagcaaaccaaacuguacggaagcggaaacaagcugaucaccgucggcuccagcaauuaccagcagucauuugucccaucgccgggcgcaagaccccaagucaacggccaguccggccgcaucgacuuccacuggcugauccugaacccgaaugacacugugaccuucucguucaacggagccuuuaucgcaccggauagagcgagcuuccugcgcggaaaaucgaugggaauccaguccgggguccaaguggaugcgaacugcgaaggagacugcuaccauuccggcggaacuaucauuucgaauuugccuuuccaaaacaucaauucccgggccgugggaaaguguccccgcuaugugaaacaggaaucgcugcuccucgccacugggaugaaaaaugugccagaaauaccgaagggacgcggccuguuuggagccauugcgggcuucauugaaaauggaugggagggccucauugaugguugguacggcuuucggcaccaaaacgcccagggagaaggaaccgcggcggacuacaaaagcacucagagcgccaucgaucagaucacgggaaagcugaaccgccugaucgaaaagaccaaccagcaauucgagcugaucgauaacgaguucaccgaaguggaaaagcagauuggcaacgugaucaacuggacccgggacagcaugacggaggucuggagcuacaaugcagaacuccugguggcgauggagaaccagcacacuaucgaccuugcugacucggagaugaacaagcuguaugaacgggucaaacgccaacucagggagaacgcagaagaagauggaacugguuguuucgagaucuuccauaagugcgacgacgauugcauggccucgauccgcaacaauacuuacgaccacuccaaguaccgggaggaggcuaugcagaaucggauccagaucgacccggucaagcucagcucaggauacaaggaugugauccugugguucucguucggcgccucgugcuuuauccuucuggcuaucgccauggguuugguguuuaucugcgugaagaaugggaauaugagauguacuauuugcaucugauaauaggcuggagccucgguggccaugcuucuugccccuugggccuccccccagccccuccuccccuuccugcacccguacccccguggucuuugaauaaagucugagugggcggc

SEQ ID NO: 1026 - DNA, 1680 bp, Influenza A virus
atgaacacccagattctcgtgttcgccctgattgccattatccccactaacgccgacaagatctgtctgggacaccacgcggtgtccaacggcaccaaggtcaacaccctgacagaaaggggggtggaggtggtcaacgccaccgaaactgtggagagaaccaacatcccgcggatttgcagcaaggggaagaggaccgtggacctgggccagtgcggactgctgggtaccatcaccggaccgccacagtgcgaccaattcctcgagtttagcgccgacctgatcatcgagcggcgcgaggggtccgacgtctgttacccgggaaagttcgtgaacgaggaagcgcttaggcagatcctgagagaatcgggcggcatcgataaggaagcgatgggattcacctactccgggattcgcacgaacggagccacctcagcttgccgccggtccggttcctccttctatgctgagatgaaatggttgctgtccaacactgacaatgcggcattcccccaaatgactaagtcctacaagaacacccggaagtcccctgccctgattgtgtggggcatccaccactcggtgtcaacggccgaacagactaagctgtacggttccggaaacaagctggtcactgtgggatccagcaactaccagcagtcctttgtgccttcgccgggggcgcggcctcaggtcaacggcctgagcggacgaatcgacttccattggctcatgctcaatcccaatgataccgtgactttctcgtttaacggggccttcattgcacccgaccgggcctcattcctccggggaaagtcgatgggaatccagtccggcgtccaagtggatgccaactgcgaaggagactgctaccactcgggaggcaccataatcagcaatctgccgttccaaaacatcgacaacagagccgtgggaaagtgcccacgctacgtgaagcagcgctccctgctgctggctactgggatgaagaacgtgcccgagattccgaaaggcagaggcttgttcggtgcaatcgccggattcattgagaacggatgggagggcctgatcgacggttggtacggcttccggcatcagaacgcccagggagaggggaccgccgcggactacaagtccactcagtccgccattgatcagatcaccggaaagctgaatcgcttgattgaaaagaccaaccagcaattcgaactgatcgacaacgagtttaacgaagtggagaagcagatcggaaacgtgatcaactggacccgggatagcatcaccgaagtctggtcctacaacgctgagcttctcgtggccatggaaaaccaacacaccattgacctcgcggactcggagatggacaagctctatgaaagagtgaaacggcagctgagggaaaacgcagaggaagatggcactggctgcttcgaaatcttccacaaatgcgacgatgattgcatggcctctatccgcaacaacacctacgaccattcaaagtaccgcgaagaggctatgcagaaccgcatccagatcgatcctgtgaagctgtccagcggctacaaggacgtgattctgtggttctcattcggcgccagctgcttcatcctgctcgccatcgtgatgggtcttgtctttatctgcgtgaagaacgggaatatgcggtgtaccatttgtatc

SEQ ID NO: 1027 - RNA, 1846 nt, Influenza A virus
gggaaauaagagagaaaagaagaguaagaagaaauauaagagccaccaugaacacccagauucucguguucgcccugauugccauuauccccacuaacgccgacaagaucugucugggacaccacgcgguguccaacggcaccaaggucaacacccugacagaaagggggguggagguggucaacgccaccgaaacuguggagagaaccaacaucccgcggauuugcagcaaggggaagaggaccguggaccugggccagugcggacugcuggguaccaucaccggaccgccacagugcgaccaauuccucgaguuuagcgccgaccugaucaucgagcggcgcgagggguccgacgucuguuacccgggaaaguucgugaacgaggaagcgcuuaggcagauccugagagaaucgggcggcaucgauaaggaagcgaugggauucaccuacuccgggauucgcacgaacggagccaccucagcuugccgccgguccgguuccuccuucuaugcugagaugaaaugguugcuguccaacacugacaaugcggcauucccccaaaugacuaaguccuacaagaacacccggaaguccccugcccugauuguguggggcauccaccacucggugucaacggccgaacagacuaagcuguacgguuccggaaacaagcuggucacugugggauccagcaacuaccagcaguccuuugugccuucgccgggggcgcggccucaggucaacggccugagcggacgaaucgacuuccauuggcucaugcucaaucccaaugauaccgugacuuucucguuuaacggggccuucauugcacccgaccgggccucauuccuccggggaaagucgaugggaauccaguccggcguccaaguggaugccaacugcgaaggagacugcuaccacucgggaggcaccauaaucagcaaucugccguuccaaaacaucgacaacagagccgugggaaagugcccacgcuacgugaagcagcgcucccugcugcuggcuacugggaugaagaacgugcccgagauuccgaaaggcagaggcuuguucggugcaaucgccggauucauugagaacggaugggagggccugaucgacgguugguacggcuuccggcaucagaacgcccagggagaggggaccgccgcggacuacaaguccacucaguccgccauugaucagaucaccggaaagcugaaucgcuugauugaaaagaccaaccagcaauucgaacugaucgacaacgaguuuaacgaaguggagaagcagaucggaaacgugaucaacuggacccgggauagcaucaccgaagucugguccuacaacgcugagcuucucguggccauggaaaaccaacacaccauugaccucgcggacucggagauggacaagcucuaugaaagagugaaacggcagcugagggaaaacgcagaggaagauggcacuggcugcuucgaaaucuuccacaaaugcgacgaugauugcauggccucuauccgcaacaacaccuacgaccauucaaaguaccgcgaagaggcuaugcagaaccgcauccagaucgauccugugaagcuguccagcggcuacaaggacgugauucugugguucucauucggcgccagcugcuucauccugcucgccaucgugaugggucuugucuuuaucugcgugaagaacgggaauaugcgguguaccauuuguaucugauaauaggcuggagccucgguggccaugcuucuugccccuugggccuccccccagccccuccuccccuuccugcacccguacccccguggucuuugaauaaagucugagugggcggc

The invention claimed is:

1. A nucleic acid vaccine, comprising:
one or more RNA polynucleotides having an open reading frame encoding a hemagglutinin protein selected from H1, H7 and H10 wherein the hemagglutinin protein is derived from a strain of Influenza A virus, wherein the RNA polynucleotide includes a chemical modification and a pharmaceutically acceptable carrier or excipient, formulated within a lipid nanoparticle, wherein the lipid nanoparticle has about 20-60 mol % ionizable cationic lipid; about 5-25 mol % non-cationic lipid; about 25-55 mol % sterol; and about 0.5-15 mol % PEG-modified lipid.

2. The vaccine of claim 1, wherein the RNA polynucleotide does not encode F protein.

3. The vaccine of claim 1, wherein the RNA polynucleotide further encodes an influenza neuraminidase protein.

4. The vaccine of claim 1, wherein the Influenza virus is selected from H1N1, H7N9, and H10N8.

5. The vaccine of claim 1 wherein the chemical modification is selected from the group consisting of pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine, and 2'-O-methyl uridine.

6. The vaccine of claim 1, wherein the ionizable cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319).

7. The vaccine of claim 1, wherein the RNA polynucleotide comprises at least one of SEQ ID Nos 941-945.

8. The vaccine of claim 1, wherein the RNA polynucleotide comprises a polynucleotide having at least 80% sequence identity to at least one of SEQ ID NOs 941-945.

9. The vaccine of claim 1, wherein the RNA polynucleotide comprises a polynucleotide encoding an amino acid sequence having at least 90% sequence identity to SEQ ID NO 941.

10. The vaccine of claim 1, wherein the RNA polynucleotide comprises a polynucleotide encoding the amino acid sequence of SEQ ID NO 941.

11. The vaccine of claim 1, wherein the RNA polynucleotide comprises a polynucleotide encoding an amino acid sequence having at least 90% sequence identity to SEQ ID NO 946.

12. The vaccine of claim 1, wherein the RNA polynucleotide comprises a polynucleotide encoding the amino acid sequence of SEQ ID NO 946.

13. The vaccine of claim 1, wherein the RNA polynucleotide comprises a polynucleotide encoding an amino acid sequence having at least 90% sequence identity to at least one of SEQ ID NO 946-950.

14. The vaccine of claim 1, wherein the RNA polynucleotide comprises a polynucleotide encoding the amino acid sequence of at least one of SEQ ID NO 946-950.

15. The vaccine of claim 1, wherein the RNA polynucleotide comprises a polynucleotide having 80-98% sequence identity to SEQ ID NO 395.

16. The vaccine of claim 1, wherein the RNA polynucleotide comprises 80-95% sequence identity to SEQ ID NO 394.

17. The vaccine of claim 1, wherein the RNA polynucleotide comprises SEQ ID NO: 395.

18. The vaccine of claim 1, wherein the lipid nanoparticle comprises a molar ratio of about 40-60 mol % ionizable cationic lipid, about 1-2 mol % PEG lipid, about 30-50 mol % cholesterol and about 5-15 mol % non-cationic lipid.

19. The vaccine of claim 1, wherein the open reading frame is codon-optimized.

20. The vaccine of claim 1, wherein the hemagglutinin protein is H1.

21. The vaccine of claim 1, wherein the hemagglutinin protein is H7.

22. The vaccine of claim 1, wherein the hemagglutinin protein is H10.

23. A nucleic acid immunogenic composition, comprising:
one or more RNA polynucleotides having an open reading frame encoding a hemagglutinin protein selected from H1, H7 and H10 wherein the hemagglutinin protein is derived from a strain of Influenza A virus, wherein the RNA polynucleotide includes a chemical modification and a pharmaceutically acceptable carrier or excipient, formulated within a lipid nanoparticle, wherein the lipid nanoparticle has about 20-60 mol % ionizable cationic lipid; about 5-25 mol % non-cationic lipid; about 25-55 mol % sterol; and about 0.5-15 mol % PEG-modified lipid.

24. The nucleic acid immunogenic composition of claim 23, wherein the hemagglutinin protein does not comprise the head domain (HA1).

25. The nucleic acid immunogenic composition of claim 23, wherein the hemagglutinin protein does not comprise the cytoplasmic domain.

26. The nucleic acid immunogenic composition of claim 23, wherein the hemagglutinin protein does not comprise the transmembrane domain.

* * * * *